United States Patent
Joung et al.

(10) Patent No.: US 11,041,155 B2
(45) Date of Patent: Jun. 22, 2021

(54) CCCTC-BINDING FACTOR VARIANTS

(71) Applicant: The General Hospital Corporation, Boston, MA (US)

(72) Inventors: J. Keith Joung, Winchester, MA (US); Rebecca Tayler Cottman, Cambridge, MA (US)

(73) Assignee: The General Hospital Corporation, Boston, MA (US)

( * ) Notice: Subject to any disclaimer, the term of this patent is extended or adjusted under 35 U.S.C. 154(b) by 61 days.

(21) Appl. No.: 16/415,989

(22) Filed: May 17, 2019

(65) Prior Publication Data
US 2019/0382767 A1   Dec. 19, 2019

Related U.S. Application Data

(60) Provisional application No. 62/828,277, filed on Apr. 2, 2019, provisional application No. 62/672,682, filed on May 17, 2018.

(51) Int. Cl.
| C12N 15/113 | (2010.01) |
| C12N 15/63 | (2006.01) |
| C12N 15/10 | (2006.01) |

(52) U.S. Cl.
CPC ...... *C12N 15/1135* (2013.01); *C12N 15/1044* (2013.01); *C12N 15/63* (2013.01)

(58) Field of Classification Search
None
See application file for complete search history.

(56) References Cited

U.S. PATENT DOCUMENTS

| 2006/0246440 A1* | 11/2006 | Joung ............... C07K 14/4702 435/6.12 |
| 2007/0213269 A1 | 10/2007 | Barbas et al. |
| 2011/0294873 A1 | 12/2011 | Mermod et al. |
| 2012/0115227 A1 | 5/2012 | Cohen-Haguenauer et al. |
| 2012/0178647 A1* | 7/2012 | Joung ............... C12N 15/1093 506/9 |
| 2016/0215280 A1 | 7/2016 | Fanucchi et al. |
| 2017/0175136 A1 | 6/2017 | Stamatoyannopoulos et al. |

FOREIGN PATENT DOCUMENTS

WO   WO 2017/031370   2/2017

OTHER PUBLICATIONS

Filippova et al., Tumor-associated Zinc Finger Mutations in the CTCF Transcription Factor Selectively Alter Its DNA-binding Specificity. Cancer Research 62, 48-52, Jan. 1, 2002 (Year: 2002).*

Filippova et al., An Exceptionally Conserved Transcriptional Repressor, CTCF, Employs Different Combinations of Zinc Fingers to Bind Diverged Promoter Sequences of Avian and Mammalian c-myc Oncogenes. Molecular and Cellular Biology, Jun. 1996, vol. 16, p. 2802-2813 (Year: 1996).*

(Continued)

*Primary Examiner* — Arthur S Leonard
(74) *Attorney, Agent, or Firm* — Fish & Richardson P.C.

(57) ABSTRACT

Described herein are engineered CCCTC-binding factor (CTCF) variants that can bind to mutant CTCF binding sequences and method of using the same.

6 Claims, 46 Drawing Sheets

Specification includes a Sequence Listing.

(56) References Cited

OTHER PUBLICATIONS

Hurt et al., Highly specific zinc finger proteins obtained by directed domain shuffling and cell-based selection. Proc Natl Acad Sci U S A. Oct. 14, 2003;100(21):12271-6 (Year: 2003).*
Guo et al., CTCF/cohesin-mediated DNA looping is required for protocadherin a promoter choice. PNAS Dec. 18, 2012 109 (51) 21081-21086 (Year: 2012).*
Ali et al, "Insulators and domains of gene expression," Curr. Opin. Genet. Dev., 2016, 37:17-26.
Guo et al, "Mutation hotspots at CTCF binding sites coupled to chromosomal instability in gastrointestinal cancers," Nat. Commun., 2018, 18;9(1):1520.
Han et al, "CTCF participates in DNA damage response via poly(ADP-ribosyl) ation ," Sci Rep., 2017, 6;7:43530.
Hashimoto et al, "Structural basis for the versatile and methylation-dependent binding of CTCF to DNA," Mol. Cell., 2017, 1;66(5):711-720.e3.
Hilmi et al, "CTCF facilitates DNA double-strand break repair by enhancing homologous recombination repair," Sci. Adv., 2017, 24;3(5):e1601898.
Joung et al, "A bacterial two-hybrid selection system for studying protein—DNA and protein—protein interactions," Proc. Natl. Acad. Sci. USA, 2000, 20;97(13):7382-7387.
Kang et al, "Disruption of CTCF/cohesin-mediated high-order chromatin structures by DNA methylation downregulates PTGS2 expression ," Oncogene, 2015, 5;34(45):5677-84.
Maeder et al, "Rapid "open-source" engineering of customized zinc-finger nucleases for highly efficient gene modification," Mol. Cell., 2008, ;31(2):294-301.
Nakahashi et al, "A Genome-wide Map of CTCF Multivalency Redefines the CTCF Code," Cell Rep., 2013, 30;3(5):1678-1689.
Nora et al, "Spatial partitioning of the regulatory landscape of the X-inactivation centre," Nature, 2012, 11;485(7398):381-5.
Ong & Corces, "CTCF: an architectural protein bridging genome topology and function," Nat. Rev. Genet., 2014, 15(4):234-46.
Phillip-Cremins et al, "Architectural protein subclasses shape 3D organization of genomes during lineage commitment," Cell, 2013, 153(6): 1281-1295.
Phillips & Corces, "CTCF: master weaver of the genome," Cell, 2009, 26:137(7): 1194-1211.
Rao et al, "A 3D map of the human genome at kilobase resolution reveals principles of chromatin looping," Cell, 2014, 159(7):1665-1680.
Rhee & Pugh, "Comprehensive genome-wide protein-DNA interactions detected at single-nucleotide resolution," Cell, 2011, 9;147(6):1408-1419.
Sander et al, "Selection-Free Zinc-Finger Nuclease Engineering by Context-Dependent Assembly (CoDA)," Nat Methods. Jan. 2011;8(1):67-9.
Schuijers et al, "Transcriptional Dysregulation of MYC Reveals Common Enhancer-Docking Mechanism," Cell Reports, 2018, 10;23(2):349-360.
Shukla et al, "CTCF-promoted RNA polymerase II pausing links DN Amethylation to splicing," Nature, 2011, 3;479(7371):74-79.
Wright et al, "Standardized reagents and protocols for engineering zinc finger nucleases by modular assembly," Nat Protoc., 2006, 1(3):1637-52.
Li et al., "Identification of critical base pairs required for CTCF binding in motif M1 and M2," Protein & Cell, Mar. 2017, 8(7):544-549.
PCT International Search Report and Written Opinion in International Appln. No. PCT/US2019/032937, dated Oct. 17, 2019, 17 pages.

* cited by examiner

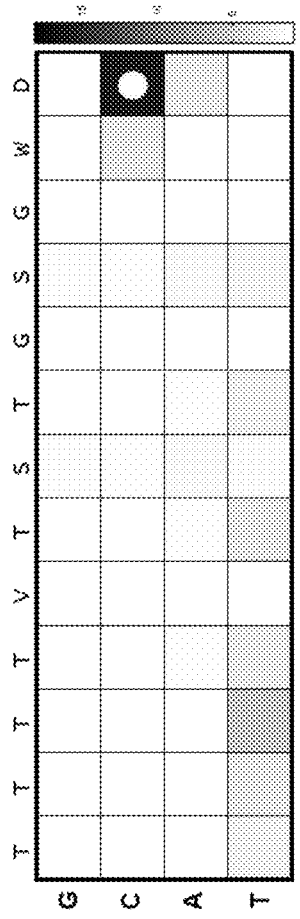
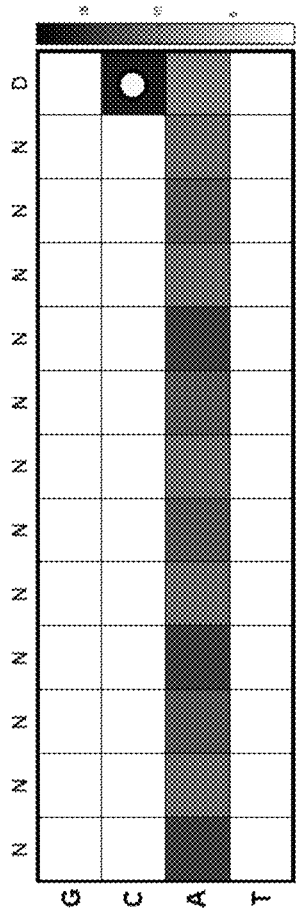
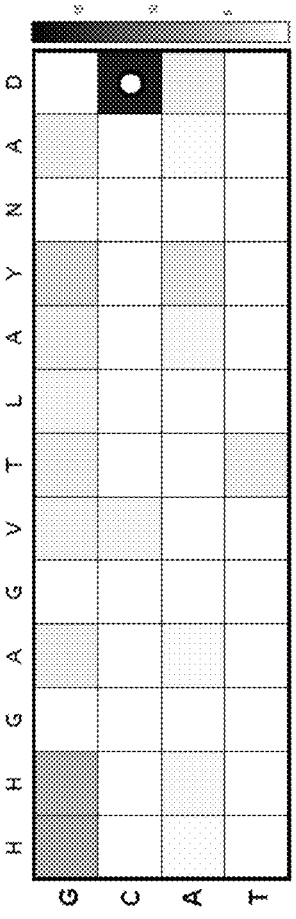
FIG. 7A
FIG. 7B
FIG. 7C
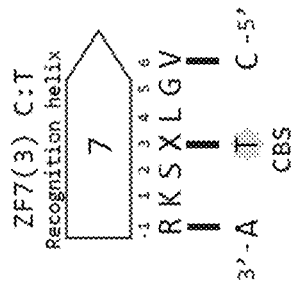
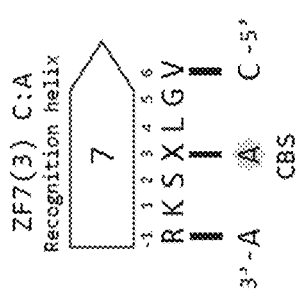
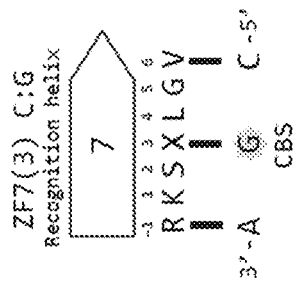

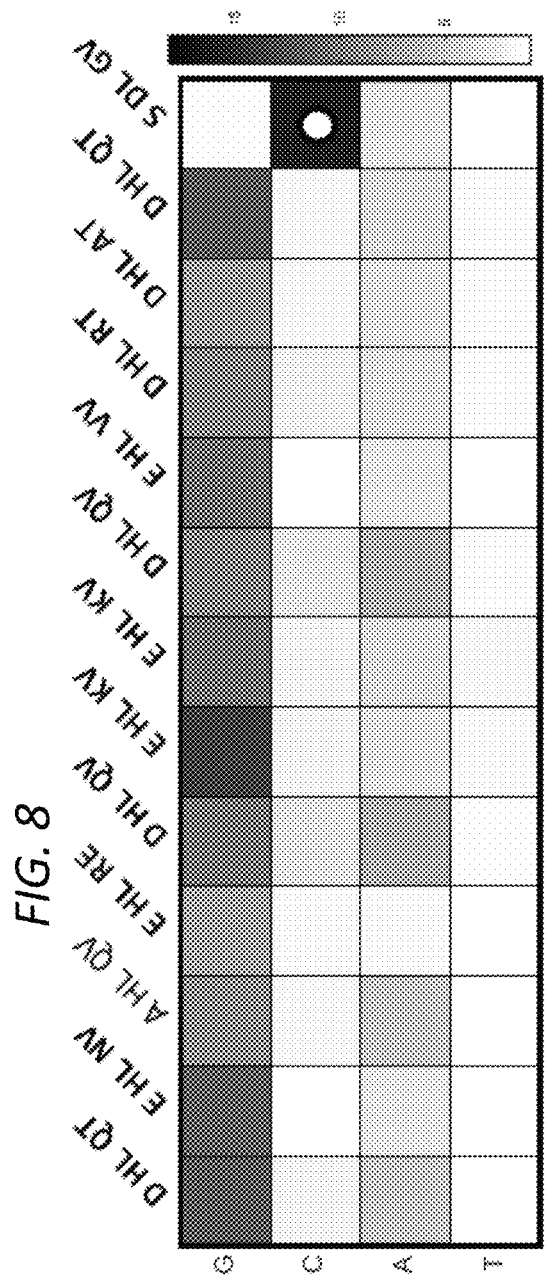
FIG. 8
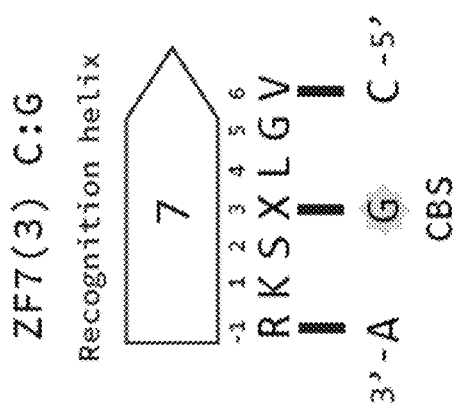

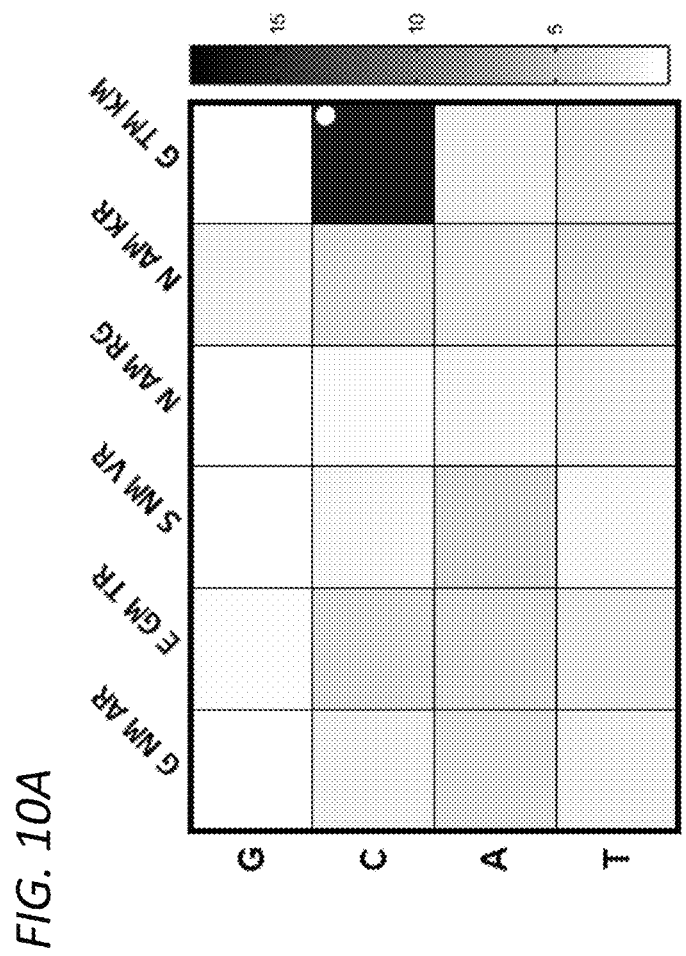
FIG. 10A
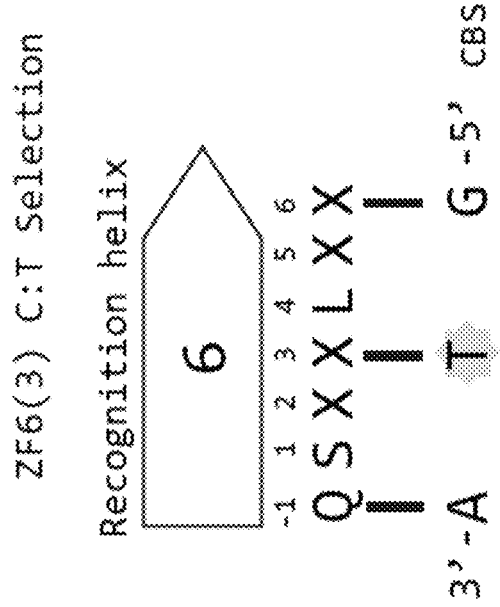

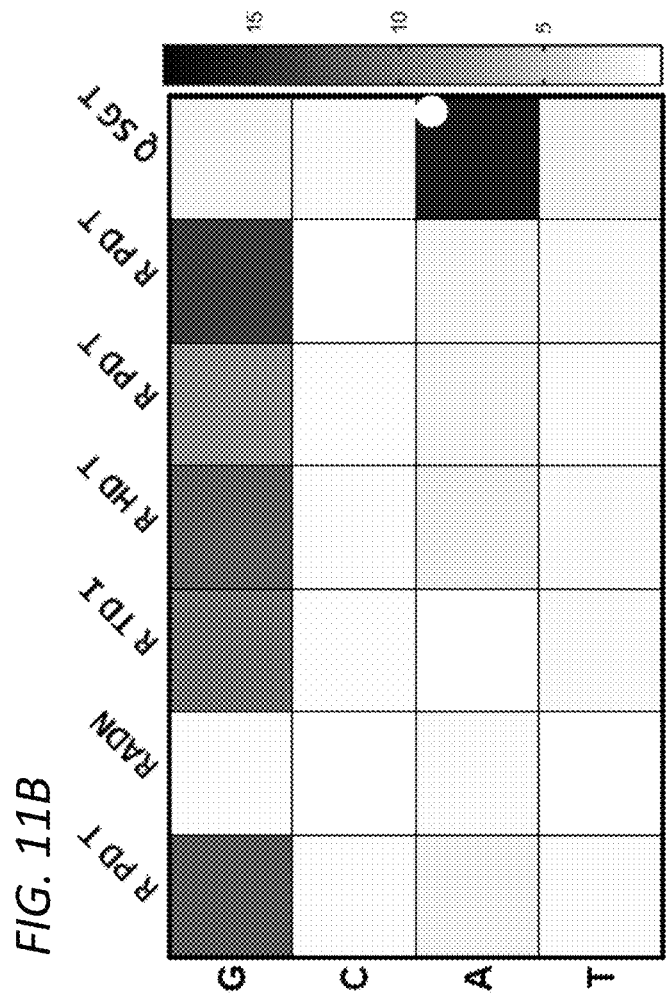
*FIG. 11B*
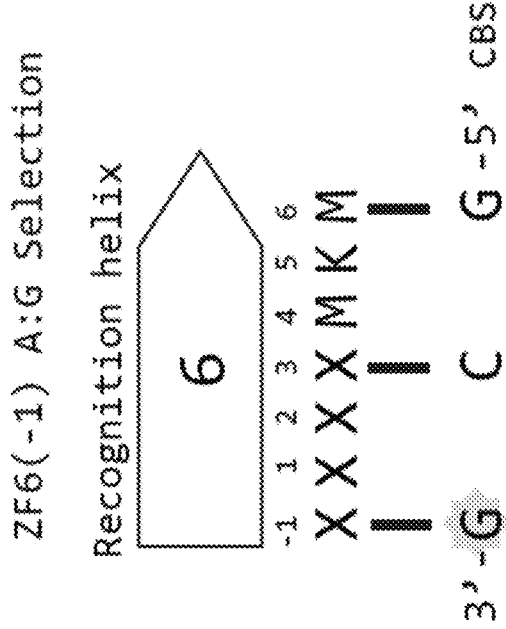

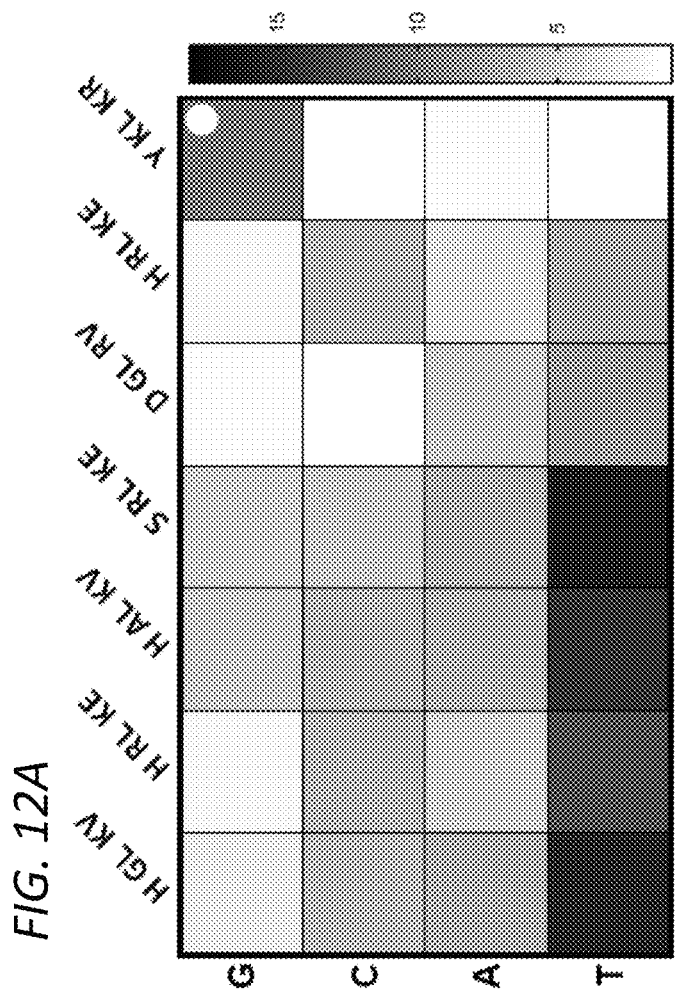
FIG. 12A
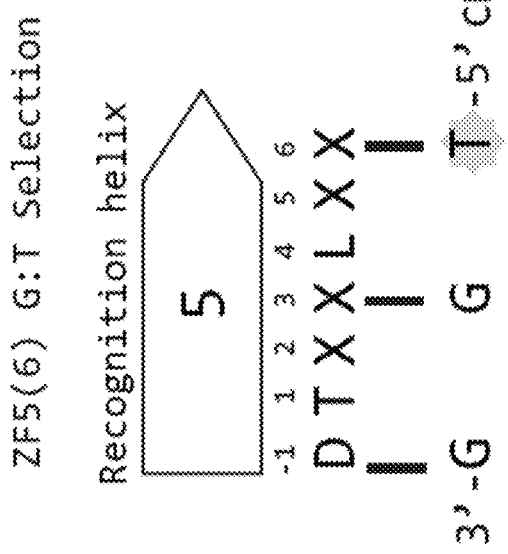

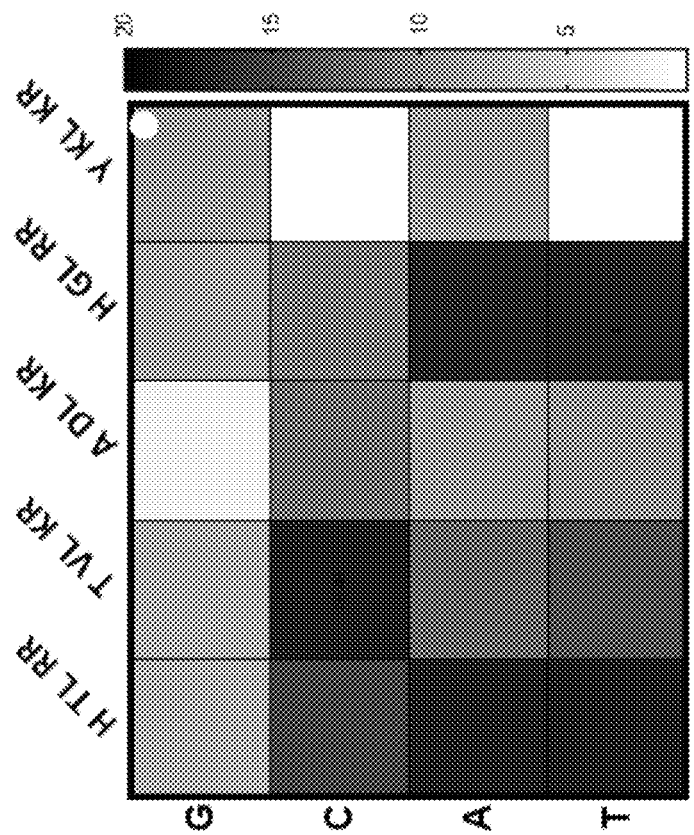
FIG. 13C
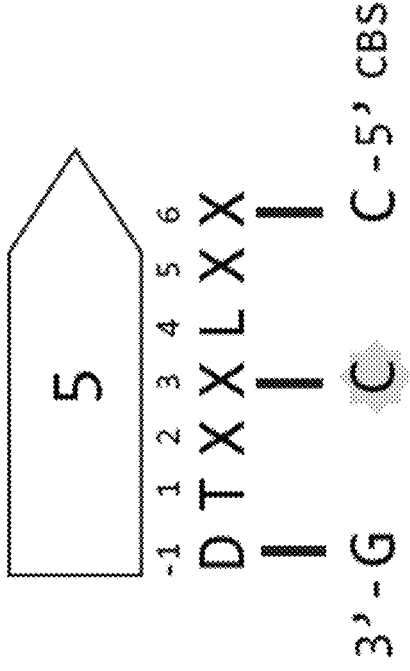

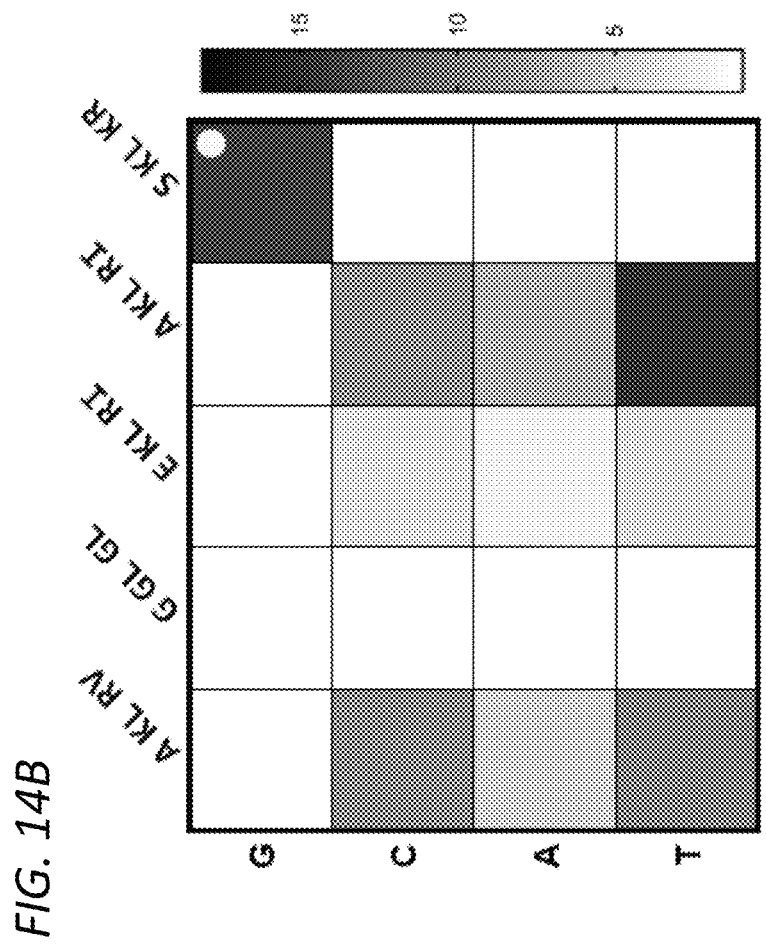
FIG. 14B
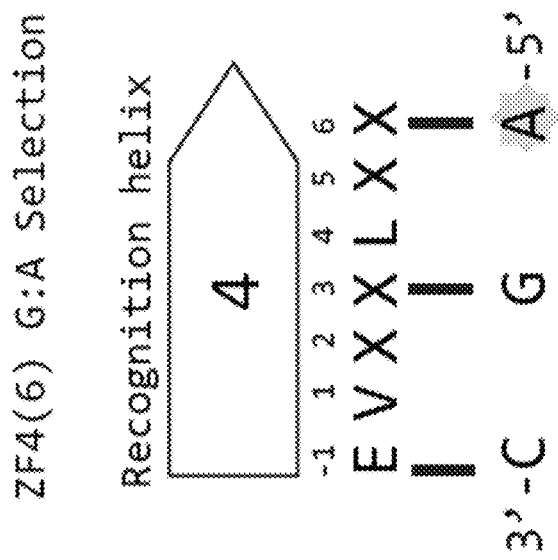

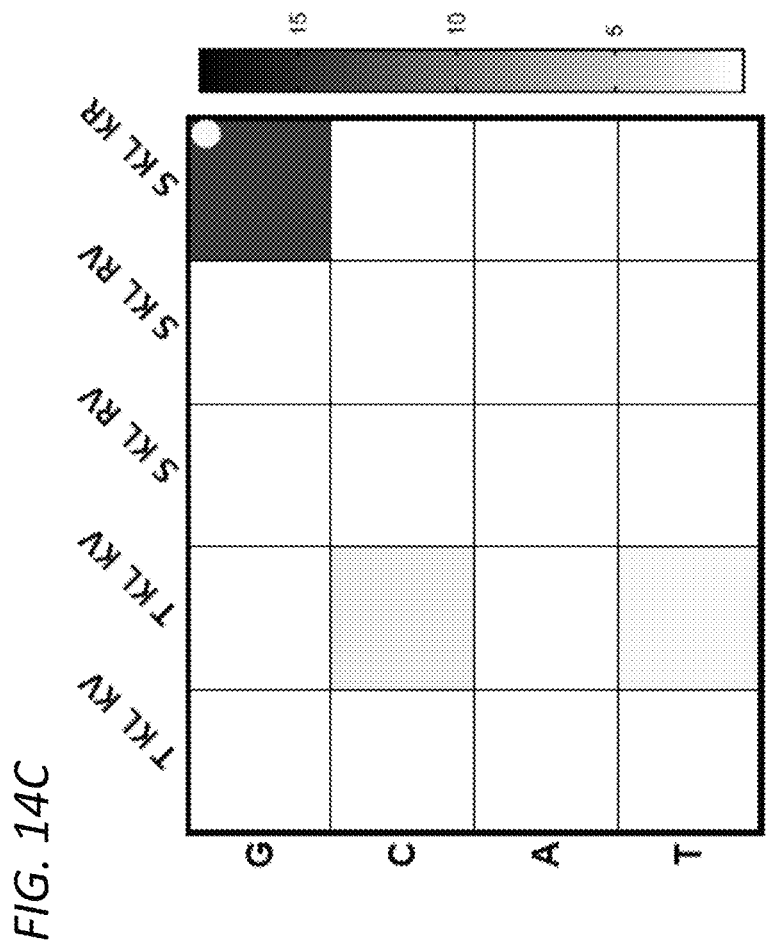
FIG. 14C
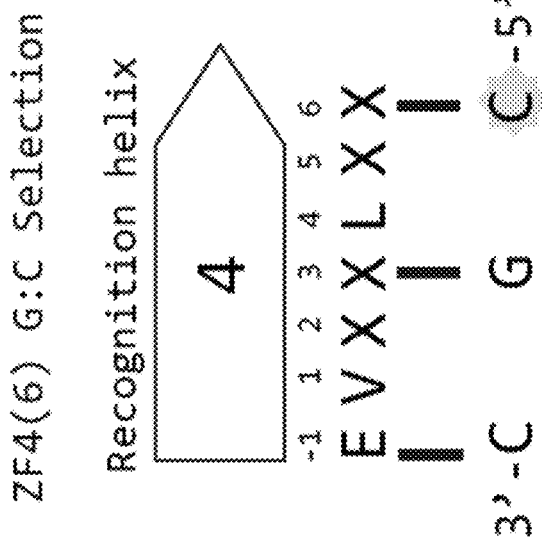

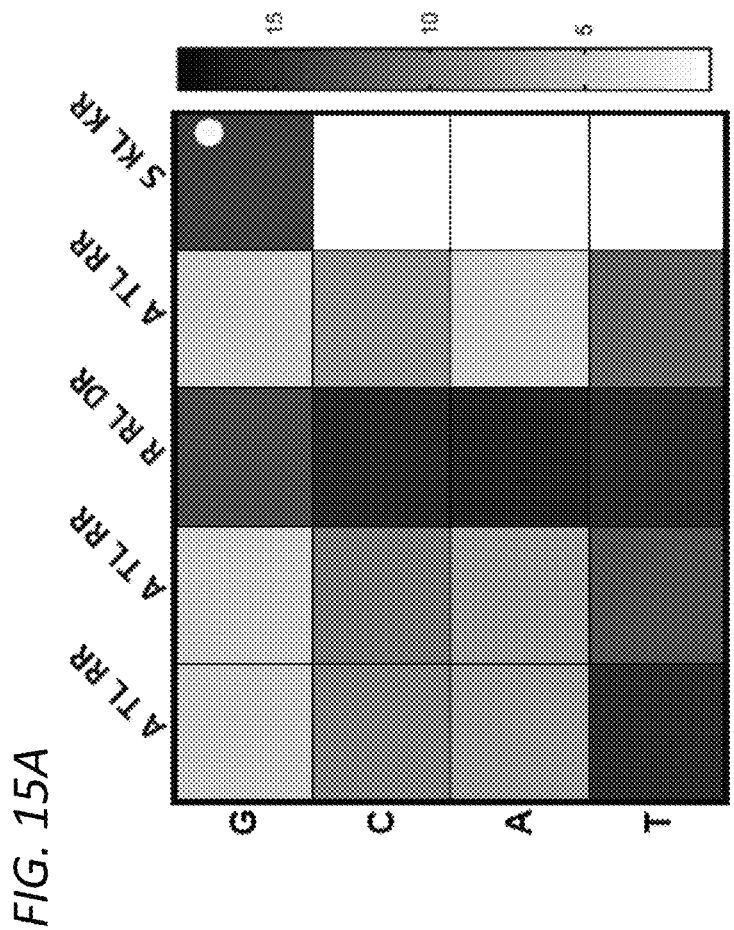
FIG. 15A
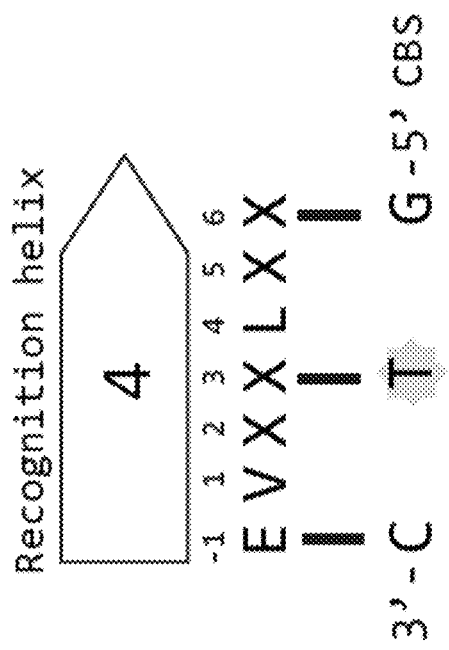

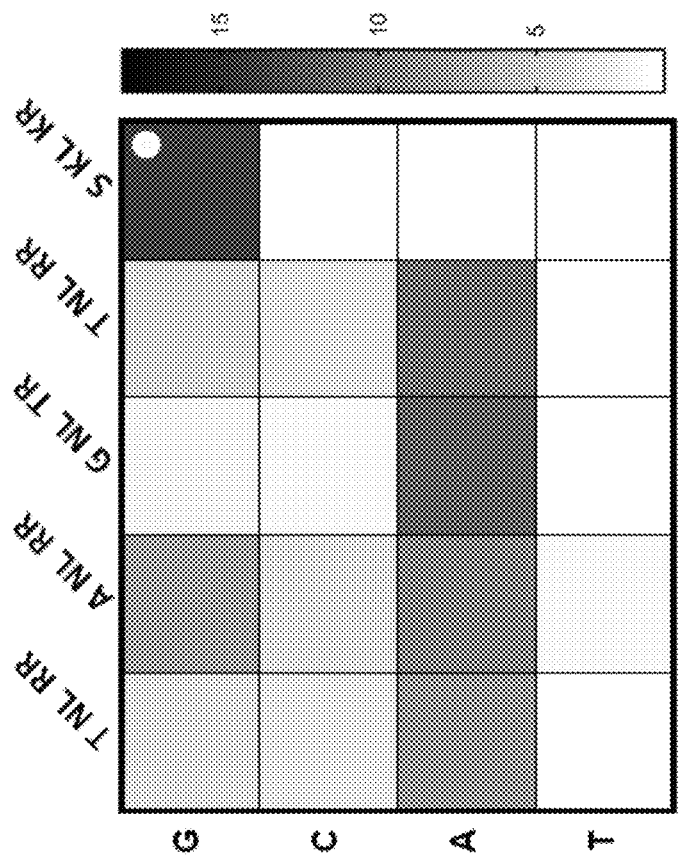
*FIG. 15B*
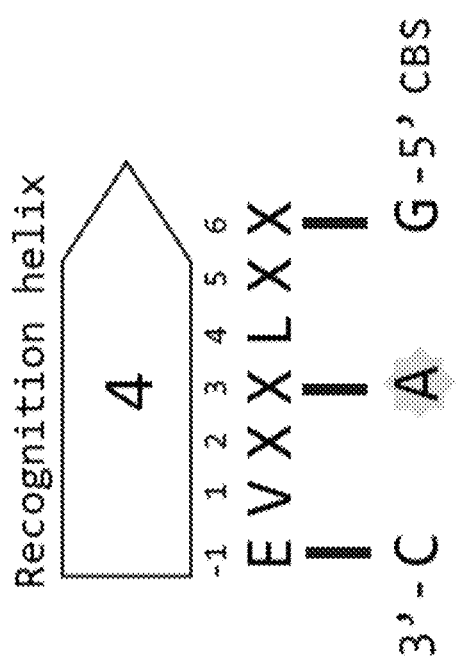

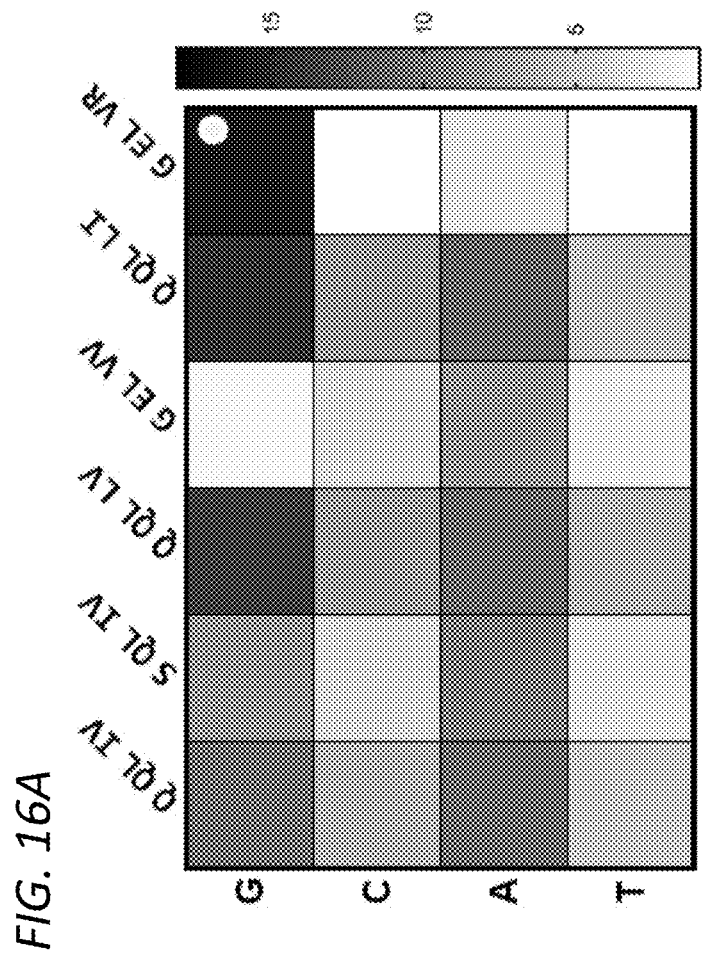
FIG. 16A
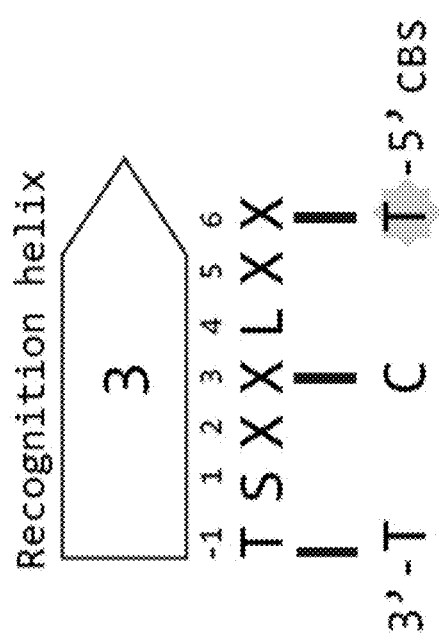

US 11,041,155 B2

CCCTC-BINDING FACTOR VARIANTS

CLAIM OF PRIORITY

This application claims the benefit of U.S. Provisional Patent Application Ser. No. 62/672,682, filed on May 17, 2018 and U.S. Provisional Patent Application Ser. No. 62/828,277, filed on Apr. 2, 2019. The entire contents of the foregoing are hereby incorporated by reference.

FEDERALLY SPONSORED RESEARCH OR DEVELOPMENT

This invention was made with Government support under Grant No. GM118158 awarded by the National Institutes of Health. The Government has certain rights in the invention.

SEQUENCE LISTING

The instant application contains a Sequence Listing which has been submitted electronically in ASCII format and is hereby incorporated by reference in its entirety. Said ASCII copy, created on Jun. 20, 2019, is named 29539-0339WO1 SL.txt and is 1,104,397 bytes in size.

TECHNICAL FIELD

The invention relates, at least in part, to engineered CCCTC-binding factor variants with altered DNA-binding specificities.

BACKGROUND

CCCTC-binding factor (CTCF) is a multi-domain protein that acts as an essential genome organizer by maintaining higher-order chromatin structure while also having a role in cell differentiation and the promotion or repression of gene expression (Ong and Corces, Nature Reviews Genetics (2014); Phillips and Corces, Cell (2009)). CTCF maintains topologically associated domains (TADs) spanning MBs of the genome as well as smaller scale Sub-TADs leading to fine-tuned gene insulation or gene activation within gene clusters (Ali et al., Current Opinion in Genetics & Development (2016); Nora et al., Nature (2012); Rao et al., Cell (2014)). In addition, CTCF has been found to regulate mRNA splicing by influencing the rate of transcription and more recently been implicated in promoting homologous recombination repair at double-strand breaks (Shukla et al., Nature (2011); Hilmi et al., Science Advances (2017); Han et al., Scientific Reports (2016)). CTCF binds throughout the genome via an 11 finger zinc finger (ZF) array that recognizes CTCF binding sites (CBSs). The CBS is typically 40 bp in length with a highly conserved 15 bp core sequence.

SUMMARY

The present invention is based, at least in part, on the development of engineered CTCF variants that can bind to mutant CBSs with higher affinity than a wild-type CTCF.

The present invention relates to an engineered CCCTC-binding factor (CTCF) variant including at least one amino acid residue in at least one zinc finger that differs in sequence from the amino acid sequence of a wild-type CTCF, where the engineered CTCF variant binds to a mutant CTCF binding sequence (CBS) with a higher affinity than wild-type CTCF, the mutant CBS including at least one nucleotide base that differs in sequence from the nucleotide sequence of a consensus CBS, where the at least one amino acid residue that differs in sequence from the amino acid sequence of a wild-type CTCF is selected from the group consisting of the amino acid residues at the position(s) −1, +1, +2, +3, +5, and +6 of any of ZF7, ZF6, ZF5, ZF4, and ZF3 of the engineered CTCF variant.

In some embodiments, the engineered CTCF variant binds with a higher affinity than a wild-type CTCF to a mutant CTCF binding sequence (CBS) that has a Thymine (T), Adenine (A), or Guanine (G) residue at position 2 of the consensus CBS motif, the engineered CTCF including an amino acid residue threonine, asparagine, or histidine at ZF7 position +3.

In some embodiments, the engineered CTCF variant binds with a higher affinity than a wild-type CTCF to a mutant CBS that has a G residue at position 2 of the consensus CBS motif, the engineered CTCF including the amino acid sequence DHLQT (SEQ ID NO: 8), EHLNV (SEQ ID NO: 9), AHLQV (SEQ ID NO: 10), EHLRE (SEQ ID NO: 11), DHLQV (SEQ ID NO: 12), EHLKV (SEQ ID NO: 13), EHLVV (SEQ ID NO: 15), DHLRT (SEQ ID NO: 16), or DHLAT (SEQ ID NO: 17) at ZF7 positions +2 to +6.

In some embodiments, the engineered CTCF variant binds with a higher affinity than a wild-type CTCF to a mutant CBS that has a T, G, or C residue at position 3 of the consensus CBS motif, the engineered CTCF at ZF7 positions −1 to +3 including: the amino acid sequence RKHD (SEQ ID NO: 173) or RRSD (SEQ ID NO: 174), where the mutant CBS has a T residue at position 3 of the consensus CBS motif; the amino acid sequence RKAD (SEQ ID NO: 175), IPRI (SEQ ID NO: 176), RKHD (SEQ ID NO: 173), or RKDD (SEQ ID NO: 177), where the mutant CBS has a G residue at position 3 of the consensus CBS motif; or the amino acid sequence GIVN (SEQ ID NO: 178), ELLN (SEQ ID NO: 179), QALL (SEQ ID NO: 180) or PHRM (SEQ ID NO: 181), where the mutant CBS has a C residue at position 3 of the consensus CBS motif.

In some embodiments, the engineered CTCF variant binds with a higher affinity than a wild-type CTCF to a mutant CBS that has a T, G, or A residue at position 5 of the consensus CBS motif, the engineered CTCF at ZF6 positions +2 to +6 including: the amino acid sequence NAMKR (SEQ ID NO: 30), GNMAR (SEQ ID NO: 182), EGMTR (SEQ ID NO: 183), SNMVR (SEQ ID NO: 184), or NAMRG (SEQ ID NO: 185), where the mutant CBS has a T residue at position 5 of the consensus CBS motif; or the amino acid sequence EHMGR (SEQ ID NO: 31), DHMNR (SEQ ID NO: 32), THMKR (SEQ ID NO: 33), EHMRR (SEQ ID NO: 34), or THMNR (SEQ ID NO: 35), where the mutant CBS has a G residue at position 5 of the consensus CBS motif.

In some embodiments, the engineered CTCF variant binds with a higher affinity than a wild-type CTCF to a mutant CBS that has a T, G, or C residue at position 6 of the consensus CBS motif, the engineered CTCF at ZF6 positions −1 to +3 including: the amino acid sequence MNES (SEQ ID NO: 36) or HRES (SEQ ID NO: 37), where the mutant CBS has a T residue at position 6 of the consensus CBS motif; or the amino acid sequence RPDT (SEQ ID NO: 38), RTDI (SEQ ID NO: 39), or RHDT (SEQ ID NO: 40), where the mutant CBS has a G residue at position 6 of the consensus CBS motif.

In some embodiments, the engineered CTCF variant binds with a higher affinity than a wild-type CTCF to a mutant CBS that has a C, A, or T residue at position 7 of the consensus CBS motif, the engineered CTCF at ZF5 positions +2 to +6 including: the amino acid sequence HGLKV (SEQ ID NO: 41), HRLKE (SEQ ID NO: 42), HALKV (SEQ ID NO: 43), SRLKE (SEQ ID NO: 44), or DGLRV (SEQ ID NO: 45), where the mutant CBS has a T residue at position 7 of the consensus CBS motif; the amino acid sequence HTLKV (SEQ ID NO: 46), or HGLKV (SEQ ID NO: 41), where the mutant CBS has an A residue at position 7 of the consensus CBS motif; or the amino acid sequence SRLKE (SEQ ID NO: 44), HRLKE (SEQ ID NO: 42) or NRLKE (SEQ ID NO: 47), where the mutant CBS has a C residue at position 7 of the consensus CBS motif.

In some embodiments, the engineered CTCF variant binds with a higher affinity than a wild-type CTCF to a mutant CBS that has a C, A, or T residue at position 8 of the consensus CBS motif, the engineered CTCF at ZF5 positions +2 to +6 including: the amino acid sequence ATLKR (SEQ ID NO: 48), QALRR (SEQ ID NO: 49), GGLVR (SEQ ID NO: 50), or HGLIR (SEQ ID NO: 51), where the mutant CBS has a T residue at position 8 of the consensus CBS motif; the amino acid sequence ANLSR (SEQ ID NO: 52), TGLTR (SEQ ID NO: 53), HGLVR (SEQ ID NO: 54), or GGLTR (SEQ ID NO: 55), where the mutant CBS has an A residue at position 8 of the consensus CBS motif; the amino acid sequence HTLRR (SEQ ID NO: 56), TVLKR (SEQ ID NO: 57), ADLKR (SEQ ID NO: 58), or HGLRR (SEQ ID NO: 59), where the mutant CBS has a C residue at position 8 of the consensus CBS motif.

In some embodiments, the engineered CTCF variant binds with a higher affinity than a wild-type CTCF to a mutant CBS that has a T, A, or C residue at position 10 of the consensus CBS motif, the engineered CTCF at ZF4 positions +2 to +6 including: the amino acid sequence AHLRK (SEQ ID NO: 60), wherein the mutant CBS has a T residue at position 10 of the consensus CBS motif; the amino acid sequence AKLRV (SEQ ID NO: 61), EKLRI (SEQ ID NO: 186), or AKLRI (SEQ ID NO: 63), where the mutant CBS has an A residue at position 10 of the consensus CBS motif; or the amino acid sequence TKLKV (SEQ ID NO: 64), wherein the mutant CBS has a C residue at position 10 of the consensus CBS motif.

In some embodiments, the engineered CTCF variant binds with a higher affinity than a wild-type CTCF to a mutant CBS that has a T, A, or C residue at position 11 of the consensus CBS motif, the engineered CTCF at ZF4 positions +2 to +6 including: the amino acid sequence ATLRR (SEQ ID NO: 66) or RRLDR (SEQ ID NO: 67), where the mutant CBS has a T residue at position 11 of the consensus CBS motif; the amino acid sequence TNLRR (SEQ ID NO: 68), ANLRR (SEQ ID NO: 69), or GNLTR (SEQ ID NO: 70), where the mutant CBS has an A residue at position 11 of the consensus CBS motif; or the amino acid sequence AMLKR (SEQ ID NO: 71), HMLTR (SEQ ID NO: 72), AMLRR (SEQ ID NO: 73), or TMLRR (SEQ ID NO: 74), where the mutant CBS has a C residue at position 11 of the consensus CBS motif.

In some embodiments, the engineered CTCF variant binds with a higher affinity than a wild-type CTCF to a mutant CBS that has a T, A, or C residue at position 13 of the consensus CBS motif, the engineered CTCF at ZF3 positions +2 to +6 including: the amino acid sequence QQLIV (SEQ ID NO: 75), SQLIV (SEQ ID NO: 76), QQLLV (SEQ ID NO: 77), GELVV (SEQ ID NO: 78), or QQLLI (SEQ ID NO: 79), where the mutant CBS has a T residue at position 13 of the consensus CBS motif; the amino acid sequence GQLIV (SEQ ID NO: 80), GQLTV (SEQ ID NO: 81), GKLVT (SEQ ID NO: 187), TELII (SEQ ID NO: 82) or QGLLV (SEQ ID NO: 83), where the mutant CBS has an A residue at position 13 of the consensus CBS motif; or the amino acid sequence QQLLT (SEQ ID NO: 84), GQLLT (SEQ ID NO: 85), GELLT (SEQ ID NO: 86), or QQLLI (SEQ ID NO: 79), where the mutant CBS has a C residue at position 13 of the consensus CBS motif.

In some embodiments, the engineered CTCF variant binds with a higher affinity than a wild-type CTCF to a mutant CBS that has A, G, T, and T residues at positions 2, 6, 7, and 10 of the consensus CBS motif, respectively, the engineered CTCF including: (i) the amino acid sequence AKLKK (SEQ ID NO: 88), AKLRK (SEQ ID NO: 89), AHLRV (SEQ ID NO: 90), AKLRV (SEQ ID NO: 61), or SKLRL (SEQ ID NO: 92) at ZF4 positions +2 to +6 of the engineered CTCF; (ii) the amino acid sequence ERLRV (SEQ ID NO: 93), NRLKV (SEQ ID NO: 94), SRLKE (SEQ ID NO: 44), or NRLKV (SEQ ID NO: 94) at ZF5 positions +2 to +6 of the engineered CTCF; (iii) the amino acid sequence RPDT (SEQ ID NO: 38), RTET (SEQ ID NO: 98), or RADV (SEQ ID NO: 99) at ZF6 positions −1 to +3 of the engineered CTCF; and (iv) the amino acid sequence DNLLA (SEQ ID NO: 100), SNLLV (SEQ ID NO: 101), DNLMA (SEQ ID NO: 102), or DNLRV (SEQ ID NO: 103) at ZF7 positions +2 to +6 of the engineered CTCF.

In some embodiments, the engineered CTCF variant binds with a higher affinity than a wild-type CTCF to a mutant CBS that has G, G, T, and T residues at positions 2, 6, 7, and 10 of the consensus CBS motif, respectively, the engineered CTCF including: (i) the amino acid sequence GHLKK (SEQ ID NO: 158), AHLRK (SEQ ID NO: 60), or GKLRI (SEQ ID NO: 106) at ZF4 positions +2 to +6 of the engineered CTCF; (ii) the amino acid sequence SRLKE (SEQ ID NO: 44), DALRR (SEQ ID NO: 108), DGLKR (SEQ ID NO: 109), or TRLRE (SEQ ID NO: 110) at ZF5 positions +2 to +6 of the engineered CTCF; (iii) the amino acid sequence at RPDTMKR (SEQ ID NO: 188) or RTENMKM (SEQ ID NO: 189) at ZF6 positions −1 to +6 of the engineered CTCF; and (iv) the amino acid sequence EHLKV (SEQ ID NO: 13), DHLLA (SEQ ID NO: 114), or HHLDV (SEQ ID NO: 115) at ZF7 positions +2 to +6 of the engineered CTCF.

In some embodiments, the engineered CTCF variant binds with a higher affinity than a wild-type CTCF to a mutant CBS that has A, G, and A residues at positions 2, 5, and 11 of the consensus CBS motif, respectively, the engineered CTCF including: (i) the amino acid sequence SNLRR (SEQ ID NO: 116), GNLVR (SEQ ID NO: 117), GNLRR (SEQ ID NO: 118), GNLKR (SEQ ID NO: 119), ANLRR (SEQ ID NO: 69), NNLRR (SEQ ID NO: 121), or TNLRR (SEQ ID NO: 68) at ZF4 positions +2 to +6 of the engineered CTCF; (ii) the amino acid sequence EHMKR (SEQ ID NO: 123), EHMRR (SEQ ID NO: 34), THMKR (SEQ ID NO: 33), EHMNR (SEQ ID NO: 126), or EHMAR (SEQ ID NO: 127) at ZF6 positions +2 to +6 of the engineered CTCF; and (iii) the amino acid sequence DNLLT (SEQ ID NO: 128), DNLLV (SEQ ID NO: 129), DNLQT (SEQ ID NO: 130), DNLLA (SEQ ID NO: 100), DNLAT (SEQ ID NO: 132), DNLQA (SEQ ID NO: 133), DNLMA (SEQ ID NO: 102), or DNLMT (SEQ ID NO: 135) at ZF7 positions +2 to +6 of the engineered CTCF.

In some embodiments, the engineered CTCF variant binds with a higher affinity than a wild-type CTCF to a mutant CBS that has G, G, and A residues at positions 2, 5, and 11 of the consensus CBS motif, respectively, the engineered CTCF including: (i) the amino acid sequence GNLVR (SEQ ID NO: 117), GNLRR (SEQ ID NO: 118), GNLAR (SEQ ID NO: 138), GNLMR (SEQ ID NO: 139), ANLRR (SEQ ID NO: 69), SNLRR (SEQ ID NO: 116), or NNLRR (SEQ ID NO: 121) at ZF4 positions +2 to +6 of the engineered CTCF; (ii) the amino acid sequence EHMNR (SEQ ID NO: 126), EHMKR (SEQ ID NO: 123), EHMRR (SEQ ID NO: 34), SHMNR (SEQ ID NO: 146), SHMRR (SEQ ID NO: 147), THMKR (SEQ ID NO: 33), or DHMNR (SEQ ID NO: 32) at ZF6 positions +2 to +6 of the engineered CTCF; and (iii) the amino acid sequence EHLKV (SEQ ID NO: 13), EHLAE (SEQ ID NO: 151), STLNE (SEQ ID NO: 152), DHLQV (SEQ ID NO: 12), EHLNV (SEQ ID NO: 9), DHLNT (SEQ ID NO: 155), EHLQA (SEQ ID NO: 156), or HHLMH (SEQ ID NO: 157) at ZF7 positions +2 to +6 of the engineered CTCF.

In some embodiments, the engineered CTCF variant binds with a higher affinity than a wild-type CTCF to a mutant CBS that has G, T, and T residues at positions 6, 7, and 10 of the consensus CBS motif, respectively, the engineered CTCF including: (i) the amino acid sequence GHLKK (SEQ ID NO: 158), AHLKK (SEQ ID NO: 159), TKLRL (SEQ ID NO: 160), TKLKL (SEQ ID NO: 161), GHLRK (SEQ ID NO: 162), THLKK (SEQ ID NO: 163), or AHLRK (SEQ ID NO: 60) at ZF4 positions +2 to +6 of the engineered CTCF; (ii) the amino acid sequence TRLKE (SEQ ID NO: 165) or SRLKE (SEQ ID NO: 44) at ZF5 positions +2 to +6 of the engineered CTCF; and (iii) the amino acid sequence RADN (SEQ ID NO: 167), RHDT (SEQ ID NO: 40), RRDT (SEQ ID NO: 169), RPDT (SEQ ID NO: 38), RTSS (SEQ ID NO: 171), or RNDT (SEQ ID NO: 172) at ZF6 positions −1 to +3 of the engineered CTCF.

In some embodiments, the engineered CTCF variant includes at least one amino acid residue in at least one zinc finger that differs in sequence from the amino acid sequence of a wild-type CTCF, where the engineered CTCF variant binds to a mutant CTCF binding sequence (CBS) with a higher affinity than wild-type CTCF, the mutant CBS including at least one nucleotide base that differs in sequence from the nucleotide sequence of a consensus CBS, where the at least one amino acid residue that differs in sequence from the amino acid sequence of a wild-type CTCF is selected from the group consisting of the amino acid residues at the position(s) −1, +1, +2, +3, +5, and +6 of any of ZF7, ZF6, ZF5, ZF4, and ZF3 of the engineered CTCF variant.

In some embodiments, the engineered CCCTC-binding factor (CTCF) variant that binds with a higher affinity than a wild-type CTCF to a mutant CTCF binding sequence (CBS) that differs from a consensus CBS at position 2 of the consensus CBS motif, the engineered CTCF including an amino acid residue threonine, asparagine, or histidine at ZF7 +3 position.

In some embodiments, the engineered CTCF variant binds with a higher affinity than a wild-type CTCF to a mutant CBS that has a C-to-G mutation at position 2 of the consensus CBS motif, the engineered CTCF including the amino acid sequence DHLQT (SEQ ID NO: 8), EHLNV (SEQ ID NO: 9), AHLQV (SEQ ID NO: 10), EHLRE (SEQ ID NO: 11), DHLQV (SEQ ID NO: 12), EHLKV (SEQ ID NO: 13), DHLQV (SEQ ID NO: 12), EHLVV (SEQ ID NO: 15), DHLRT (SEQ ID NO: 16), DHLAT (SEQ ID NO: 17), or DHLQT (SEQ ID NO: 8) at ZF7 positions +2 to +6.

In some embodiments, the engineered CTCF variant binds with a higher affinity than a wild-type CTCF to a mutant CBS that differs from a consensus CBS at position 3 of the consensus CBS motif, the engineered CTCF including the amino acid sequence RKHD (SEQ ID NO: 173), RRSD (SEQ ID NO: 174), GIVN (SEQ ID NO: 178), ELLN (SEQ ID NO: 179), or PHRM (SEQ ID NO: 181) at ZF7 positions −1 to +3.

In some embodiments, the engineered CTCF variant binds with a higher affinity than a wild-type CTCF to a mutant CBS that differs from a consensus CBS at position 5 of the consensus CBS motif, the engineered CTCF including the amino acid sequence NAMKR (SEQ ID NO: 30), EHMGR (SEQ ID NO: 31), DHMNR (SEQ ID NO: 32), THMKR (SEQ ID NO: 33), EHMRR (SEQ ID NO: 34), or THMNR (SEQ ID NO: 35) at ZF6 positions +2 to +6.

In some embodiments, the engineered CTCF variant binds with a higher affinity than a wild-type CTCF to a mutant CBS that differs from a consensus CBS at position 6 of the consensus CBS motif, the engineered CTCF including the amino acid sequence MNES (SEQ ID NO: 36), HRES (SEQ ID NO: 37), RPDT (SEQ ID NO: 38), RTDI (SEQ ID NO: 39), or RHDT (SEQ ID NO: 40) at ZF6 positions −1 to +3.

In some embodiments, the engineered CTCF variant binds with a higher affinity than a wild-type CTCF to a mutant CBS that differs from a consensus CBS at position 7 of the consensus CBS motif, the engineered CTCF including the amino acid sequence HGLKV (SEQ ID NO: 41), HRLKE (SEQ ID NO: 42), HALKV (SEQ ID NO: 43), SRLKE (SEQ ID NO: 44), DGLRV (SEQ ID NO: 45), HTLKV (SEQ ID NO: 46), or NRLKE (SEQ ID NO: 47) at ZF5 positions +2 to +6.

In some embodiments, the engineered CTCF variant binds with a higher affinity than a wild-type CTCF to a mutant CBS that differs from a consensus CBS at position 8 of the consensus CBS motif, the engineered CTCF including the amino acid sequence ATLKR (SEQ ID NO: 48), QALRR (SEQ ID NO: 49), GGLVR (SEQ ID NO: 50), HGLIR (SEQ ID NO: 51), ANLSR (SEQ ID NO: 52), TGLTR (SEQ ID NO: 53), HGLVR (SEQ ID NO: 54), GGLTR (SEQ ID NO: 55), HTLRR (SEQ ID NO: 56), TVLKR (SEQ ID NO: 57), ADLKR (SEQ ID NO: 58), or HGLRR (SEQ ID NO: 59) at ZF5 positions +2 to +6.

In some embodiments, the engineered CTCF variant binds with a higher affinity than a wild-type CTCF to a mutant CBS that differs from a consensus CBS at position 10 of the consensus CBS motif, the engineered CTCF including the amino acid sequence AHLRK (SEQ ID NO: 60), AKLRV (SEQ ID NO: 61), GGLGL (SEQ ID NO: 62), AKLRI (SEQ ID NO: 63), TKLKV (SEQ ID NO: 64), or SKLRV (SEQ ID NO: 65) at ZF4 positions +2 to +6.

In some embodiments, the engineered CTCF variant binds with a higher affinity than a wild-type CTCF to a mutant CBS that differs from a consensus CBS at position 11 of the consensus CBS motif, the engineered CTCF including the amino acid sequence ATLRR (SEQ ID NO: 66), RRLDR (SEQ ID NO: 67), TNLRR (SEQ ID NO: 68), ANLRR (SEQ ID NO: 69), GNLTR (SEQ ID NO: 70), AMLKR (SEQ ID NO: 71), HMLTR (SEQ ID NO: 72), AMLRR (SEQ ID NO: 73), or TMLRR (SEQ ID NO: 74) at ZF4 positions +2 to +6.

In some embodiments, the engineered CTCF variant binds with a higher affinity than a wild-type CTCF to a mutant CBS that differs from a consensus CBS at position 13 of the consensus CBS motif, the engineered CTCF including the amino acid sequence QQLIV (SEQ ID NO: 75), SQLIV (SEQ ID NO: 76), QQLLV (SEQ ID NO: 77), GELVV (SEQ ID NO: 78), QQLLI (SEQ ID NO: 79), GQLIV (SEQ ID NO: 80), GQLTV (SEQ ID NO: 81), TELII (SEQ ID NO: 82), QGLLV (SEQ ID NO: 83), QQLLT (SEQ ID NO: 84), GQLLT (SEQ ID NO: 85), GELLT (SEQ ID NO: 86), or QQLLI (SEQ ID NO: 79) at ZF3 positions +2 to +6.

In some embodiments, the engineered CTCF variant binds with a higher affinity than a wild-type CTCF to a mutant CBS that differs from a consensus CBS at positions 2, 6, 7, and 10 of the consensus CBS motif, the engineered CTCF including:

(i) the amino acid sequence AKLKK (SEQ ID NO: 88), AKLRK (SEQ ID NO: 89), AHLRV (SEQ ID NO: 90), AKLRV (SEQ ID NO: 61), or SKLRL (SEQ ID NO: 92) at ZF4 positions +2 to +6;

(ii) the amino acid sequence ERLRV (SEQ ID NO: 93), NRLKV (SEQ ID NO: 94), SRLKE (SEQ ID NO: 44), or NRLKV (SEQ ID NO: 94) at ZF5 positions +2 to +6;

(iii) the amino acid sequence RPDT (SEQ ID NO: 38), RTET (SEQ ID NO: 98), or RADV (SEQ ID NO: 99) at ZF6 positions −1 to +3; and (iv) the amino acid sequence DNLLA (SEQ ID NO: 100), SNLLV (SEQ ID NO: 101), DNLMA (SEQ ID NO: 102), or DNLRV (SEQ ID NO: 103) at ZF7 positions +2 to +6.

In some embodiments, the engineered CTCF variant binds with a higher affinity than a wild-type CTCF to a mutant CBS that differs from a consensus CBS at positions 2, 6, 7, and 10 of the consensus CBS motif, the engineered CTCF including:

(i) the amino acid sequence GHLKK (SEQ ID NO: 158), AHLRK (SEQ ID NO: 60), or GKLRI (SEQ ID NO: 106) at ZF4 positions +2 to +6;

(ii) the amino acid sequence SRLKE (SEQ ID NO: 44), DALRR (SEQ ID NO: 108), DGLKR (SEQ ID NO: 109), or TRLRE (SEQ ID NO: 110) at ZF5 positions +2 to +6;

(iii) the amino acid sequence at RPDTMKR (SEQ ID NO: 188) or RTENMKM (SEQ ID NO: 189) at ZF6 positions −1 to +36; and (iv) the amino acid sequence EHLKV (SEQ ID NO: 13), DHLLA (SEQ ID NO: 114), or HHLDV (SEQ ID NO: 115) at ZF7 positions +2 to +6.

In some embodiments, the engineered CTCF variant binds with a higher affinity than a wild-type CTCF to a mutant CBS that differs from a consensus CBS at positions 2, 5, and 11 of the consensus CBS motif, the engineered CTCF including:

(i) the amino acid sequence SNLRR (SEQ ID NO: 116), GNLVR (SEQ ID NO: 117), GNLRR (SEQ ID NO: 118), GNLKR (SEQ ID NO: 119), ANLRR (SEQ ID NO: 69), NNLRR (SEQ ID NO: 121), or TNLRR (SEQ ID NO: 68) at ZF4 positions +2 to +6;

(ii) the amino acid sequence EHMKR (SEQ ID NO: 123), EHMRR (SEQ ID NO: 34), THMKR (SEQ ID NO: 33), EHMNR (SEQ ID NO: 126), or EHMAR (SEQ ID NO: 127) at ZF6 positions +2 to +6; and (iii) the amino acid sequence DNLLT (SEQ ID NO: 128), DNLLV (SEQ ID NO: 129), DNLQT (SEQ ID NO: 130), DNLLA (SEQ ID NO: 100), DNLAT (SEQ ID NO: 132), DNLQA (SEQ ID NO: 133), DNLMA (SEQ ID NO: 102), or DNLMT (SEQ ID NO: 135) at ZF7 positions +2 to +6.

In some embodiments, the engineered CTCF variant binds with a higher affinity than a wild-type CTCF to a mutant CBS that differs from a consensus CBS at positions 2, 5, and 11 of the consensus CBS motif, the engineered CTCF including:

(i) the amino acid sequence GNLVR (SEQ ID NO: 117), GNLRR (SEQ ID NO: 118), GNLAR (SEQ ID NO: 138), GNLMR (SEQ ID NO: 139), ANLRR (SEQ ID NO: 69), SNLRR (SEQ ID NO: 116), or NNLRR (SEQ ID NO: 121) at ZF4 positions +2 to +6;

(ii) the amino acid sequence EHMNR (SEQ ID NO: 126), EHMKR (SEQ ID NO: 123), EHMRR (SEQ ID NO: 34), SHMNR (SEQ ID NO: 146), SHMRR (SEQ ID NO: 147), THMKR (SEQ ID NO: 33), or DHMNR (SEQ ID NO: 32) at ZF6 positions +2 to +6; and (iii) the amino acid sequence EHLKV (SEQ ID NO: 13), EHLAE (SEQ ID NO: 151), STLNE (SEQ ID NO: 152), DHLQV (SEQ ID NO: 12), EHLNV (SEQ ID NO: 9), DHLNT (SEQ ID NO: 155), EHLQA (SEQ ID NO: 156), or HHLMH (SEQ ID NO: 157) at ZF7 positions +2 to +6.

In one embodiment, the engineered CTCF variant binds with a higher affinity than a wild-type CTCF to a mutant CBS that differs from a consensus CBS at positions 6, 7, and 10 of the consensus CBS motif, the engineered CTCF including:

(i) the amino acid sequence GHLKK (SEQ ID NO: 158), AHLKK (SEQ ID NO: 159), TKLRL (SEQ ID NO: 160), TKLKL (SEQ ID NO: 161), GHLRK (SEQ ID NO: 162), THLKK (SEQ ID NO: 163), or AHLRK (SEQ ID NO: 60) at ZF4 positions +2 to +6;

(ii) the amino acid sequence TRLKE (SEQ ID NO: 165) or SRLKE (SEQ ID NO: 44) at ZF5 positions +2 to +6; and (iii) the amino acid sequence RADN (SEQ ID NO: 167), RHDT (SEQ ID NO: 40), RRDT (SEQ ID NO: 169), RPDT (SEQ ID NO: 38), RTSS (SEQ ID NO: 171), or RNDT (SEQ ID NO: 172) at ZF6 positions −1 to +3.

In some embodiments, the engineered CTCF variant interacts with cohesion to mediate the formation of an enhancer-promoter loop to modulate gene expression.

In another aspect, the invention features a method of treating a subject in need thereof, the method including administering to the subject a therapeutically effective amount of an engineered CTCF variant described herein.

In some embodiments, the subject can have cancer.

In another aspect, the invention features a method of activating or repressing expression of a gene which is under the control of a CBS bearing one or more mutations, the method including contacting an engineered CTCF described herein with a sequence of interest in the gene, such that the expression of the gene is regulated.

In another aspect, the invention features a pharmaceutical composition including an engineered CTCF variant described herein.

In another aspect, the invention features a gene expression system for regulation of a gene, the system including a nucleic acid encoding an engineered CTCF variant according described herein.

In another aspect, the invention features a method of altering the structure of chromatin including contacting an engineered CTCF variant described herein with a sequence of interest to form a binding complex, such that the structure of the chromatin is altered.

In another aspect, the invention features a method of activating or repressing expression of a gene which is under the control of a CBS bearing one or more mutations, the method including contacting the CBS bearing one or more mutations with an engineered CTCF variant described herein.

In another aspect, the invention features a kit including an engineered CTCF variant described herein.

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

DESCRIPTION OF DRAWINGS

The following Detailed Description, given by way of example, but not intended to limit the invention to specific embodiment described, may be understood in conjunction with the accompanying figures, incorporated herein by reference.

FIG. 1 discloses SEQ ID NO: 5544.

FIG. 3 discloses SEQ ID NOS 5545-5548 and 5544, respectively, in order of appearance.

FIG. 4 discloses SEQ ID NO: 5544.

FIG. 5 discloses SEQ ID NOS 5549-5550 and 5544, respectively, in order of appearance.

FIGS. 7A-C: Binding activity of variants on altered CTCF binding sites. Variants picked from the high stringency gradient of the selective plates were tested for binding activity on sequences representing all four possible nucleotides at position 2 of the core sequence (gray star). Amino acid sequence of variants pulled out of the selection were listed above the heat map and the nucleotide present at position 2 of the core sequence was indicated on the y-axis. FIG. 7A: The nucleotide at position 2 is T. FIG. 7B: The nucleotide at position 2 is A. FIG. 7C: The nucleotide at Binding was quantified by the beta-galactosidase reporter system and colorimetric ONPG assay. Binding activity of wild-type CTCF zinc finger array on the wild-type binding site sequence was indicated by the white dot. A diagram of the ZF7 alpha recognition helix for each nucleotide change is on the left. It included the amino acid residues interacting with the triplet in the binding sequence. The amino acid at position 3 of the alpha helix was varied in the library and is indicated by an 'X'. FIGS. 7A-C disclose "RKSXLGV" as SEQ ID NO: 5551.

FIG. 8: Increasing the variation within the recognition helix produced stronger binders. Four amino acids were targeted for variance in the library to allow for more flexibility in the selection and generate stronger binders to the modified binding site of choice. ZF7 targeting a C:G change at position 2 (gray star) of the core sequence was selected for variants using the expanded approach. Each amino acid codon was replaced with 'VNS' codons at the indicated sites ('X'). Twelve colonies were picked from the high-stringency end of the selection and tested for their ability to bind to the CTCF binding site when the indicated nucleotide is at positon 2 of core sequence. Amino acid sequence of the variants selected are listed on the x-axis and the nucleotide at position two of the core sequence is on the y-axis. Wild-type zinc finger array binding activity on wild-type binding sequence is indicated by the white dot. FIG. 8 discloses "RKSXLGV" as SEQ ID NO: 5551, "AHLQV" as SEQ ID NO: 10, "DHLRT" as SEQ ID NO: 16, "DHLAT" as SEQ ID NO: 17, "DHLQT" as SEQ ID NO: 8, "DHLQV" as SEQ ID NO: 12, "SDLGV" as SEQ ID NO: 5552, "EHLKV" as SEQ ID NO: 13, "EHLVV" as SEQ ID NO: 15, "EHLNV" as SEQ ID NO: 9 and "EHLRE" as SEQ ID NO: 11.

FIGS. 9A-C disclose "RKSD" as SEQ ID NO: 711, "RKHD" as SEQ ID NO: 173, "RRSD" as SEQ ID NO: 174, "RKAD" as SEQ ID NO: 175, "IPRI" as SEQ ID NO: 176, "RKDD" as SEQ ID NO: 177, "QALL" as SEQ ID NO: 180, "PHRM" as SEQ ID NO: 181, "ELLN" as SEQ ID NO: 179 and "GIVN" as SEQ ID NO: 178.

FIGS. 10A-B: Selections performed targeting sequence changes at position 5 of the core motif in the CBS. Selections performed on library of variants centered around alterations in position 2 to 6 of the ZF6 recognition helix, leaving the 4th position unchanged. 'VNS' codons were introduced at positions indicated by 'X' and selected against three different nucleotide changes at position 5 of the core motif in the core motif of the CBS (gray star). Direct protein-DNA contacts were indicated by dashed lines. (A) Selections performed on C:T change in the binding site, (B) C:G change. No variants grew beyond the low stringency end of the gradient on selection plates for C:A change and were considered weak/insufficient binders. Most variants pulled out had relaxed binding specificity instead of altered specificity with the exception of THMKR' (SEQ ID NO: 33) targeting C:G change in the binding sequence. FIGS. 10A-B disclose "GNMAR" as SEQ ID NO: 182, "NAMKR" as SEQ ID NO: 30, "EGMTR" as SEQ ID NO: 183, "NAMRG" as SEQ ID NO: 185, "GTMKM" as SEQ ID NO: 1255, "SNMVR" as SEQ ID NO: 184, "DHMNR" as SEQ ID NO: 32, "EHMRR" as SEQ ID NO: 34, "EHMGR" as SEQ ID NO: 31, "THMNR" as SEQ ID NO: 35 and "THMKR" as SEQ ID NO: 33.

FIGS. 11A-C: Selections performed targeting sequence changes at position 6 of the core motif in the CBS. Selections performed on library of variants centered around alterations in position −1 to 3 of ZF6 recognition helix. 'VNS' codons were introduced at positions indicated by 'X' and selected against three different nucleotide changes at position 6 of the core motif in the CBS (gray star). Direct protein-DNA contacts are indicated by dashed lines. (A) Selections performed on A:T change in the binding site, (B) A:G change, (C) A:C change. Variants analyzed from the A:T selection had relaxed binding profile while variants from A:G selection showed strong binding for only the changed nucleotide. No good binders were identified in the A:C selection. FIGS. 11A-C disclose "NINES" as SEQ ID NO: 36, "QSGT" as SEQ ID NO: 1582, "HRES" as SEQ ID NO: 37, "RHDT" as SEQ ID NO: 40, "RPDT" as SEQ ID NO: 38, "RTDI" as SEQ ID NO: 39, "RADN" as SEQ ID NO: 167 and "ERKS" as SEQ ID NO: 1479.

FIGS. 12A-C: Selections performed targeting sequence changes at position 7 of the core motif in the CBS. Selections performed on library of variants centered around alterations in position 4 to 6 of ZF5 recognition helix, leaving the 4th position unchanged. 'VNS' codons were introduced at positions indicated by 'X' and selected against three different nucleotide changes at position 7 of the core motif in the CBS (gray star). Direct protein-DNA contacts are indicated by a line. (A) Selections performed on G:T change in the binding site, (B) G:A change, (C) G:C change. FIGS. 12A-C disclose "DGLRV" as SEQ ID NO: 45, "HGLKV" as SEQ ID NO: 41, "HRLKE" as SEQ ID NO: 42, "HALKV" as SEQ ID NO: 43, "YKLKR" as SEQ ID NO: 5553, "SRLKE" as SEQ ID NO: 44, "HTLKV" as SEQ ID NO: 46 and "NRLKE" as SEQ ID NO: 47.

FIGS. 13A-C: Selections performed targeting sequence changes at position 8 of the core motif in the CBS. Selections performed on library of variants centered around alterations in position 2 to 6 of ZF5 recognition helix, leaving the 4th position unchanged. 'VNS' codons were introduced at positions indicated by 'X' and selected against three different nucleotide changes at position 8 of the core motif in the CBS (gray star). Direct protein-DNA contacts are indicated by a line. (A) Selections performed on G:T change in the binding site, (B) G:A change, (C) G:C change. Note the different variants that appear with the same library being used to bind to the same changes in the sequence, but in a different position on the binding site. FIGS. 13A-C disclose "GGLVR" as SEQ ID NO: 50, "QALRR" as SEQ ID NO: 49, "HGLIR" as SEQ ID NO: 51, "YKLKR" as SEQ ID NO: 5553, "ATLKR" as SEQ ID NO: 48, "GGLTR" as SEQ ID NO: 55, "HGLVR" as SEQ ID NO: 54, "ANLSR" as SEQ ID NO: 52, "TGLTR" as SEQ ID NO: 53, "HGLRR"

as SEQ ID NO: 59, "ADLKR" as SEQ ID NO: 58, "HTLRR" as SEQ ID NO: 56 and "TVLKR" as SEQ ID NO: 57.

Figure 14A:
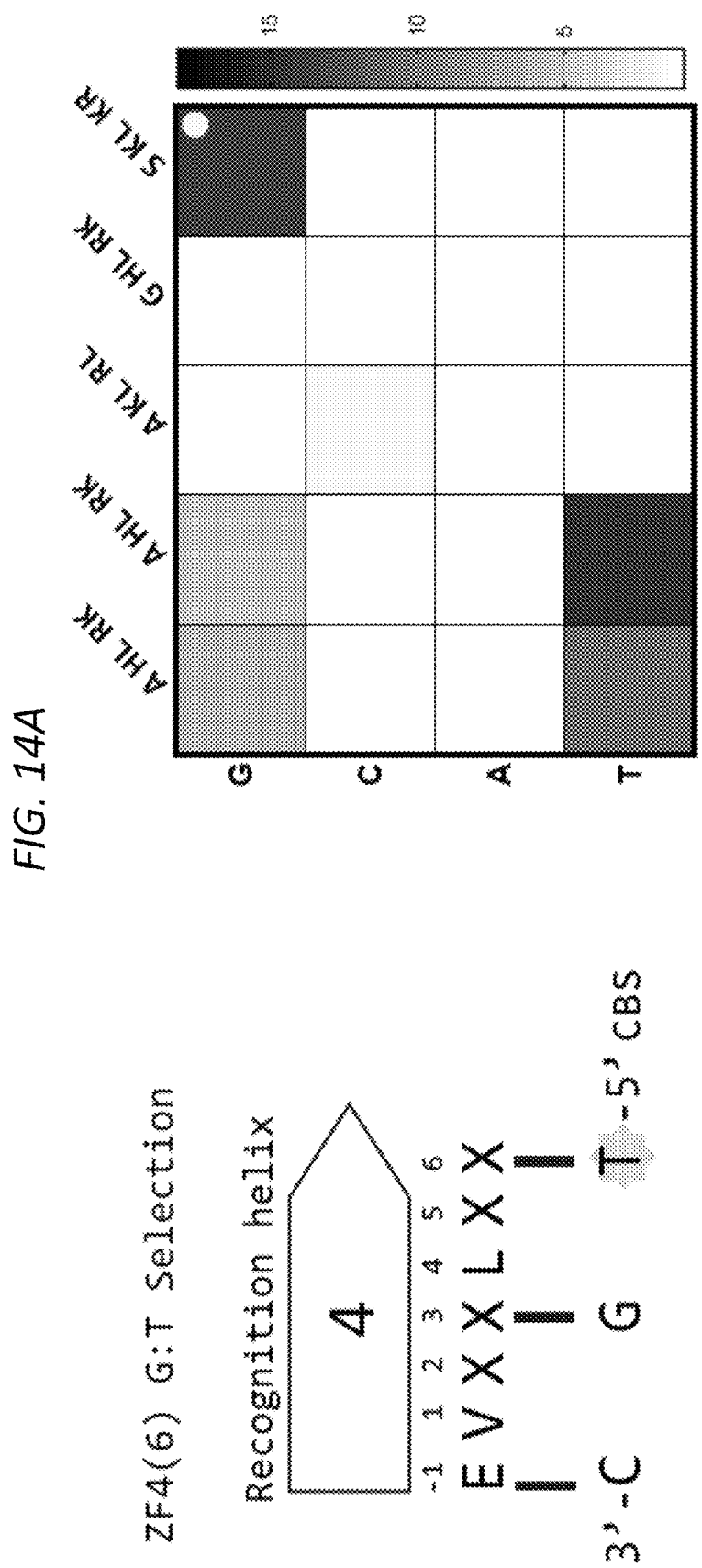
Figure 15C:
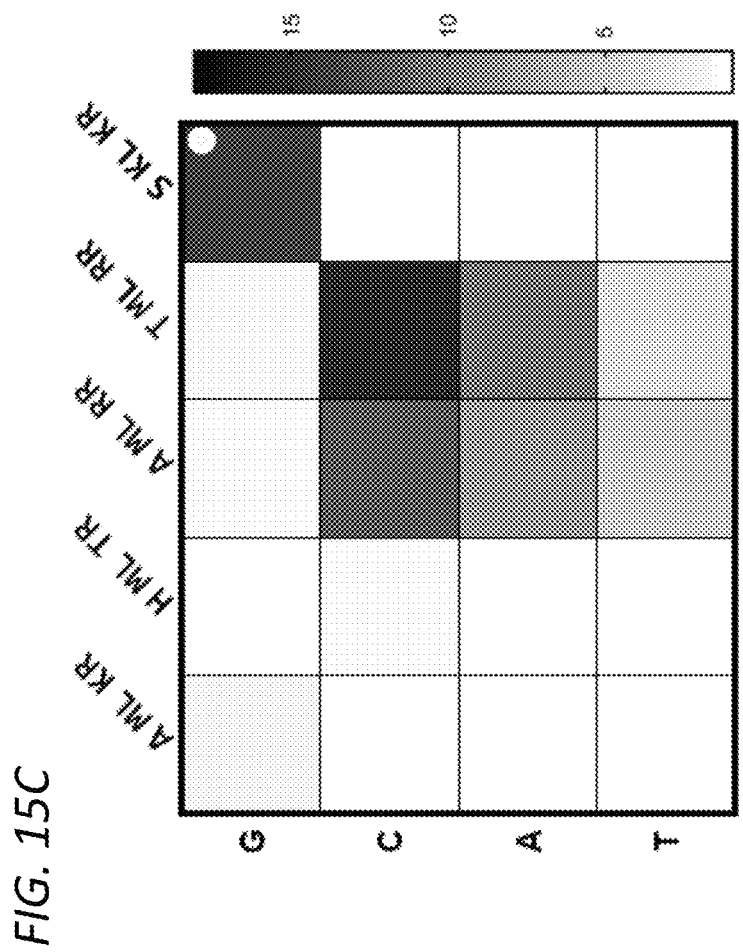
Figure 16B:
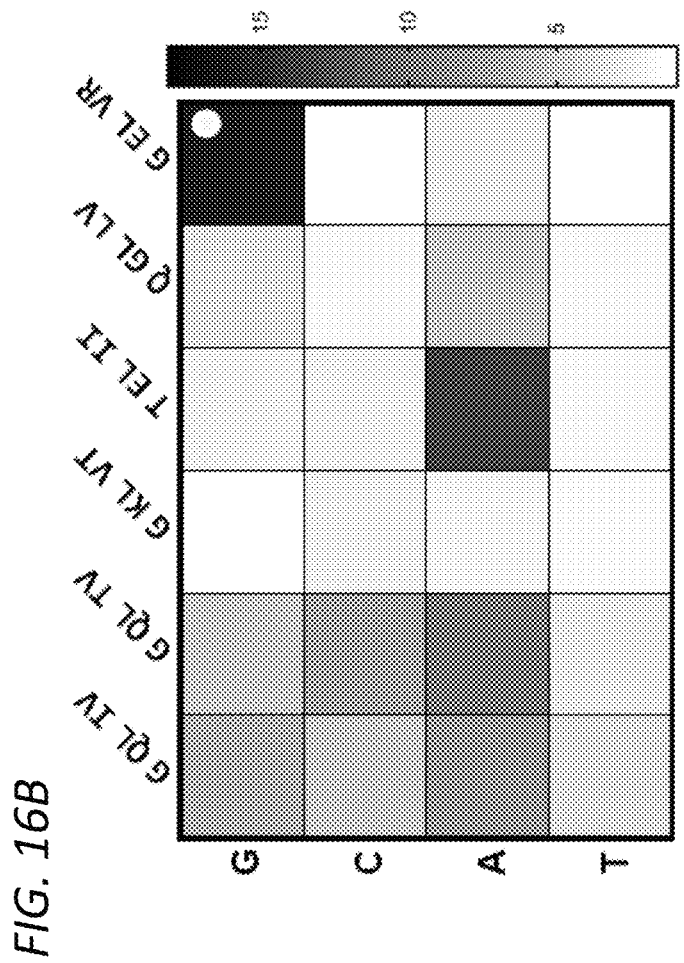
Figure 16C:
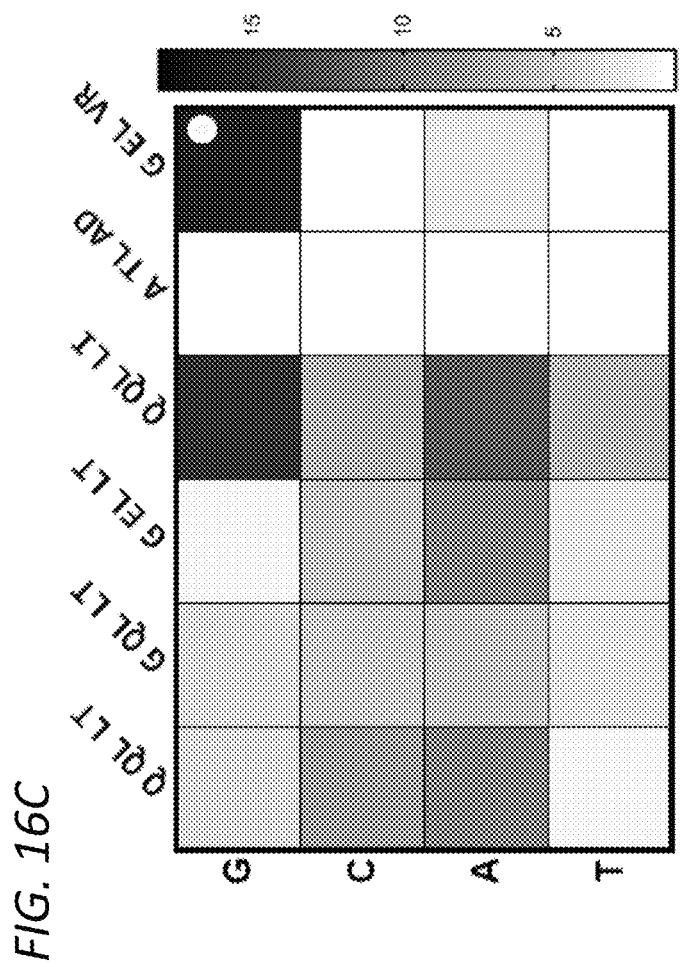
Figure 16C:
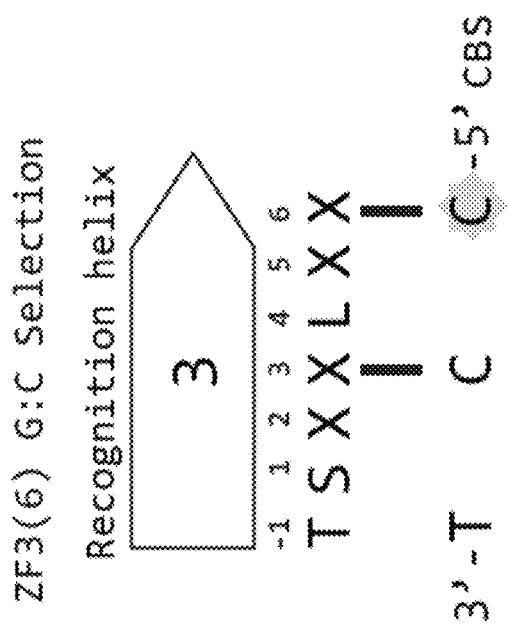
Figure 17:
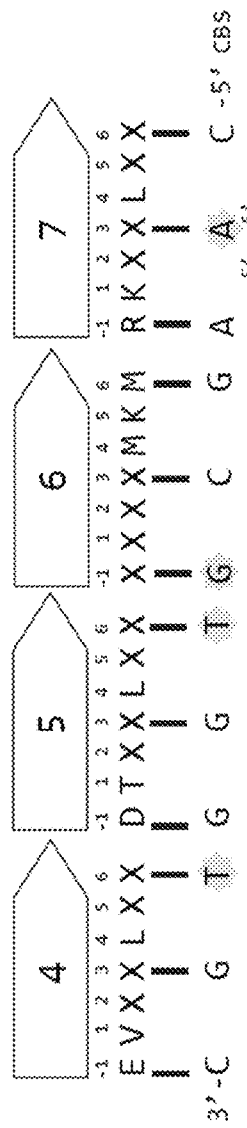
Figure 18:
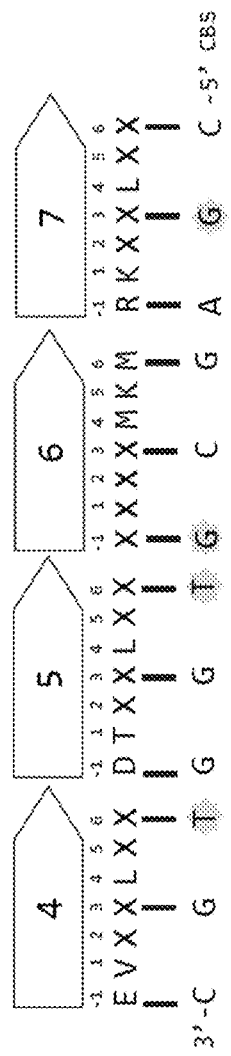
Figure 19:
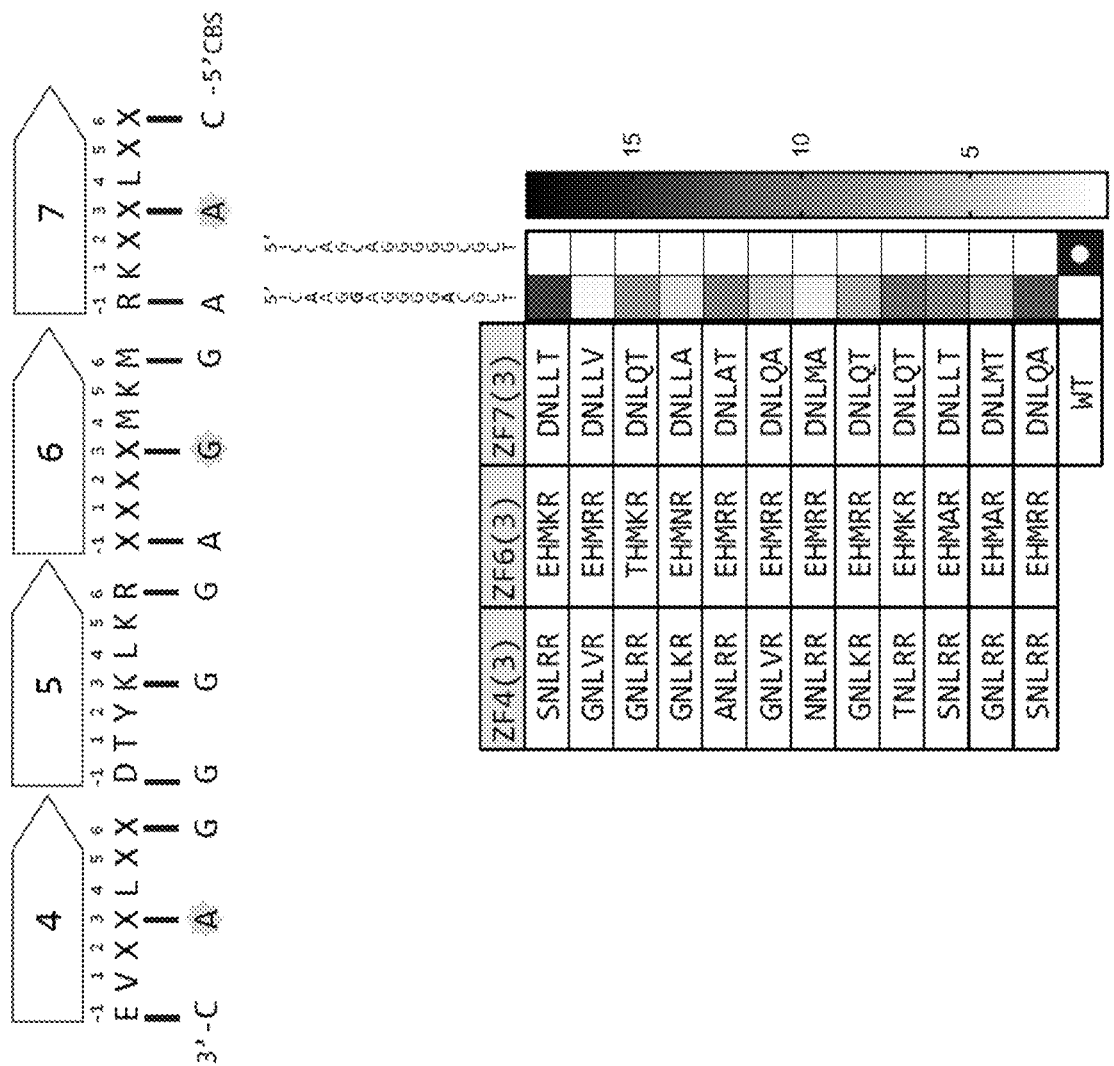

FIGS. 14A-C: Selections performed targeting sequence changes at position 10 of the core motif in the CBS. Selections performed on library of variants centered around alterations in position 2 to 6 of ZF4 recognition helix, leaving the 4th position unchanged. 'VNS' codons were introduced at positions indicated by 'X' and selected against three different nucleotide changes at position 10 of the core motif in the CBS (gray star). Direct protein-DNA contacts are indicated by a line. (A) Selections performed on G:T change in the binding site, (B) G:A change, (C) G:C change. G:C selection did not produce any growth at the high stringency end of the gradient selective plates. Binding data reflects colonies picked from mid-tier region, which is why they did not perform well as binders. White dot indicates wild-type CTCF zinc finger array binding activity on wild-type binding sequence. FIGS. 14A-C disclose "GHLRK" as SEQ ID NO: 162, "AKLRL" as SEQ ID NO: 3311, "AHLRK" as SEQ ID NO: 60, "SKLKR" as SEQ ID NO: 3470, "GGLGL" as SEQ ID NO: 62, "AKLRI" as SEQ ID NO: 63, "AKLRV" as SEQ ID NO: 61, "EKLRI" as SEQ ID NO: 186, "SKLRV" as SEQ ID NO: 65 and "TKLKV" as SEQ ID NO: 64.

FIGS. 15A-C: Selections performed targeting sequence changes at position 11 of the core motif in the CBS. Selections performed on library of variants centered around alterations in position 2 to 6 of ZF4 recognition helix, leaving the 4th position unchanged. 'VNS' codons were introduced at positions indicated by 'X' and selected against three different nucleotide changes at position 11 of the core motif in the CBS (gray star). Direct protein-DNA contacts are indicated by a line. (A) Selections performed on G:T change in the binding site, (B) G:A change, (C) G:C change. FIGS. 15A-C disclose "RRLDR" as SEQ ID NO: 67, "SKLKR" as SEQ ID NO: 3470, "ATLRR" as SEQ ID NO: 66, "GNLTR" as SEQ ID NO: 70, "ANLRR" as SEQ ID NO: 69, "TNLRR" as SEQ ID NO: 68, "AMLRR" as SEQ ID NO: 73, "AMLKR" as SEQ ID NO: 71, "HMLTR" as SEQ ID NO: 72 and "TMLRR" as SEQ ID NO: 74.

FIGS. 16A-C: Selections performed targeting sequence changes at position 13 of the core motif in the CBS. Selections performed on library of variants centered around alterations in position 2 to 6 of ZF3 recognition helix, leaving the 4th position unchanged. 'VNS' codons were introduced at positions indicated by 'X' and selected against three different nucleotide changes at position 13 of the core motif in the CBS (gray star). Direct protein-DNA contacts are indicated by a line. (A) Selections performed on G:T change in the binding site, (B) G:A change, (C) G:C change. FIGS. 16A-C disclose "QQLLI" as SEQ ID NO: 79, "QQLLV" as SEQ ID NO: 77, "QQLIV" as SEQ ID NO: 75, "GELVV" as SEQ ID NO: 78, "GELVR" as SEQ ID NO: 5554, "SQLIV" as SEQ ID NO: 76, "QGLLV" as SEQ ID NO: 83, "GQLTV" as SEQ ID NO: 81, "GQLIV" as SEQ ID NO: 80, "GKLVT" as SEQ ID NO: 187, "TELII" as SEQ ID NO: 82, "GQLLT" as SEQ ID NO: 85, "QQLLT" as SEQ ID NO: 84, "GELLT" as SEQ ID NO: 86 and "ATLAD" as SEQ ID NO: 5555.

FIG. 17: Binding activity of multi-finger variants on multiple sequence changes to the CBS. Diagram of the recognition helices of zinc finger 4-7 out of the 11 finger array, binding to their respective triplets in the core motif of the CBS. Altered amino acids are indicated by 'X' and nucleotide changes to the wild-type CBS are indicated by a gray star in the diagram and by bolded letters. ZF1-3 and ZF8-11 were unmodified in this library Protein-DNA contacts are indicated by lines between the ZF recognition helices and the CBS sequence. Wild-type CTCF 11-finger zinc finger array binding strength to wild-type CBS is indicated by a white dot. The amino acid sequence of each variant recognition helix in ZF4-7 are listed on the y-axis and binding activity on the modified CBS (changes in red) or the wild-type CBS are reflected by B2H β-gal reporter assay. FIG. 17 discloses "CGTGGTGCGAAC" as SEQ ID NO: 5556, "CAAGCGTGGTGCGCT" as SEQ ID NO: 5557, "CCAGCAGGGGGCGCT" as SEQ ID NO: 5558, "ERLRV" as SEQ ID NO: 93, "RPDT" as SEQ ID NO: 38, "DNLLA" as SEQ ID NO: 100, "AKLKK" as SEQ ID NO: 88, "AKLRK" as SEQ ID NO: 89, "NRLKV" as SEQ ID NO: 94, "RTET" as SEQ ID NO: 98, "SNLLV" as SEQ ID NO: 101, "AHLRV" as SEQ ID NO: 90, "SRLKE" as SEQ ID NO: 44, "DNLMA" as SEQ ID NO: 102, "AKLRV" as SEQ ID NO: 61, "SKLRL" as SEQ ID NO: 92, "RADV" as SEQ ID NO: 99 and "DNLRV" as SEQ ID NO: 103.

FIG. 18: Binding activity of multi-finger variants on multiple sequence changes to the CBS. The same selection as before except now there is a C:G change at position 2 of the CBS, where previously there was a C:A change. Variants pulled out of this selection had binding activity on the modified CBS without binding to the wild-type CBS. Wild-type 11-finger ZF array only showed binding activity on wild-type CBS (white dot) and no ability to bind to the modified CBS. Interestingly, the dominant variant selected for in the library contained a mutation that occurs at position 9 of the recognition helix that was either introduced during oligo synthesis (0.05% chance of the wrong nucleotide at each position) or through PCR while constructing these libraries. FIG. 18 discloses "CGTGGTGCGAGC" as SEQ ID NO: 5559, "CGAGCGTGGTGCGCT" as SEQ ID NO: 5560, "CCAGCAGGGGGCGCT" as SEQ ID NO: 5558, "GHLKK" as SEQ ID NO: 158, "SRLKE" as SEQ ID NO: 44, "EHLKV" as SEQ ID NO: 13, "RPDT(MK)R" as SEQ ID NO: 5561, "AHLRK" as SEQ ID NO: 60, "DALRR" as SEQ ID NO: 108, "RTEN" as SEQ ID NO: 112, "DHLLA" as SEQ ID NO: 114, "DGLKR" as SEQ ID NO: 109, "RPDT" as SEQ ID NO: 38, "HHLDV" as SEQ ID NO: 115, "GKLRI" as SEQ ID NO: 106 and "TRLRE" as SEQ ID NO: 110.

FIG. 19: Binding activity of multi-finger variants on multiple sequence changes to the CBS. Variants from individual pooled high stringency selections were stitched together and selected against three changes to the wild-type CBS (indicated by gray stars or bolded). Variants were assayed for binding on the modified CBS and the wild-type CBS alongside wild-type CTCF zinc finger array. The variants picked out of the selection were able to bind to the modified CBS, but not the wild-type sequence. Inversely, the wild-type zinc finger array was able to bind to the wild-type CBS, but not the modified one. FIG. 19 discloses "DTYKLKR" as SEQ ID NO: 3, "CAGGGGAGGAAC" as SEQ ID NO: 5562, "CAAGGAGGGGACGCT" as SEQ ID NO: 5563, "CCAGCAGGGGGCGCT" as SEQ ID NO: 5558, "SNLRR" as SEQ ID NO: 116, "EHMKR" as SEQ ID NO: 123, "DNLLT" as SEQ ID NO: 128, "GNLVR" as SEQ ID NO: 117, "EHMIRR" as SEQ ID NO: 34, "DNLLV" as SEQ ID NO: 129, "GNLRR" as SEQ ID NO: 118, "THMKR" as SEQ ID NO: 33, "DNLQT" as SEQ ID NO: 130, "GNLKR" as SEQ ID NO: 119, "EHMNR" as SEQ ID NO: 126, "DNLLA" as SEQ ID NO: 100, "ANLRR" as SEQ ID NO: 69, "DNLAT" as SEQ ID NO: 132, "DNLQA" as SEQ ID NO: 133, "NNLRR" as SEQ ID NO: 121, "DNLMA" as SEQ ID NO: 102, "TNLRR" as SEQ ID NO: 68, "EHMAR" as SEQ ID NO: 127 and "DNLMT" as SEQ ID NO: 135.

Figure 20:
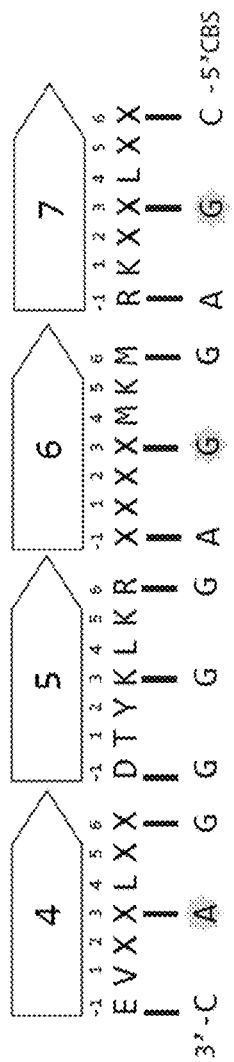

FIG. 20: Binding activity of multi-finger variants on multiple sequence changes to the CBS. Variants from individual pooled high stringency selections were stitched together and selected against three changes to the wild-type CBS (indicated by gray stars or bolded). Variants were assayed for binding on the modified CBS and the wild-type CBS alongside wild-type CTCF zinc finger array. The variants picked out of the selection were able to bind to the modified CBS, but not the wild-type sequence. Inversely, the wild-type zinc finger array was able to bind to the wild-type CBS, but not the modified one. FIG. 20 discloses "DTYKLKR" as SEQ ID NO: 3, "CAGGGGAGGAGC" as SEQ ID NO: 5564, "CGAGGAGGGGACGCT" as SEQ ID NO: 5565, "CCAGCAGGGGGCGCT" as SEQ ID NO: 5558, "GNLVR" as SEQ ID NO: 117, "EHMNR" as SEQ ID NO: 126, "EHLKV" as SEQ ID NO: 13, "GNLRR" as SEQ ID NO: 118, "EHMKR" as SEQ ID NO: 123, "EHLAE" as SEQ ID NO: 151, "GNLAR" as SEQ ID NO: 138, "EHMRR" as SEQ ID NO: 34, "STLNE" as SEQ ID NO: 152, "GNLMR" as SEQ ID NO: 139, "SHMNR" as SEQ ID NO: 146, "DHLQV" as SEQ ID NO: 12, "ANLRR" as SEQ ID NO: 69, "SHMRR" as SEQ ID NO: 147, "EHLNV" as SEQ ID NO: 9, "SNLRR" as SEQ ID NO: 116, "DHLNT" as SEQ ID NO: 155, "EHLQA" as SEQ ID NO: 156, "NNLRR" as SEQ ID NO: 121, "THMKR" as SEQ ID NO: 33, "DHMNR" as SEQ ID NO: 32 and "HHLMH" as SEQ ID NO: 157.

Figure 21:
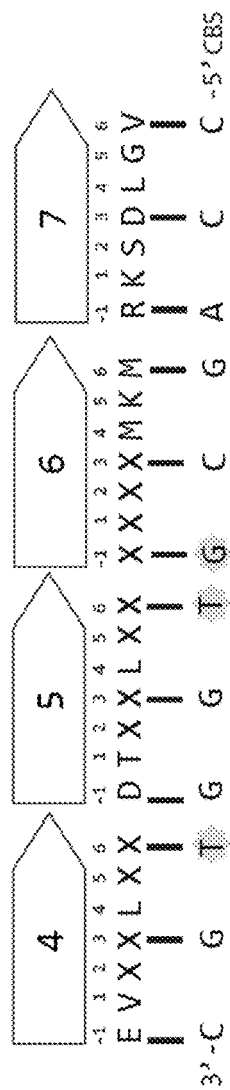

FIG. 21: Binding activity of multi-finger variants on multiple sequence changes to the CBS. Variants from individual pooled high stringency selections were stitched together and selected against three changes to the wild-type CBS (indicated by gray stars or bolded). Variants were assayed for binding on the modified CBS and the wild-type CBS alongside wild-type CTCF zinc finger array. The variants picked out of the selection were able to bind to the modified CBS, but not the wild-type sequence. Inversely, the wild-type zinc finger array was able to bind to the wild-type CBS (white dot), but not the modified one. FIG. 21 discloses "CGTGGTGCGACC" as SEQ ID NO: 5566, "RKSDLGV" as SEQ ID NO: 5, "CCAGCGTGGTGCGCT" as SEQ ID NO: 5567, "CCAGCAGGGGGCGCT" as SEQ ID NO: 5558, "GHLKK" as SEQ ID NO: 158, "TRLKE" as SEQ ID NO: 165, "RADN" as SEQ ID NO: 167, "AHLKK" as SEQ ID NO: 159, "RHDT" as SEQ ID NO: 40, "TKLRL" as SEQ ID NO: 160, "SRLKE" as SEQ ID NO: 44, "RRDT" as SEQ ID NO: 169, "TKLKL" as SEQ ID NO: 161, "RPDT" as SEQ ID NO: 38, "GHLRK" as SEQ ID NO: 162, "RTSS" as SEQ ID NO: 171, "RNDT" as SEQ ID NO: 172, "THLKK" as SEQ ID NO: 163 and "AHLRK" as SEQ ID NO: 60.

Figure 22:
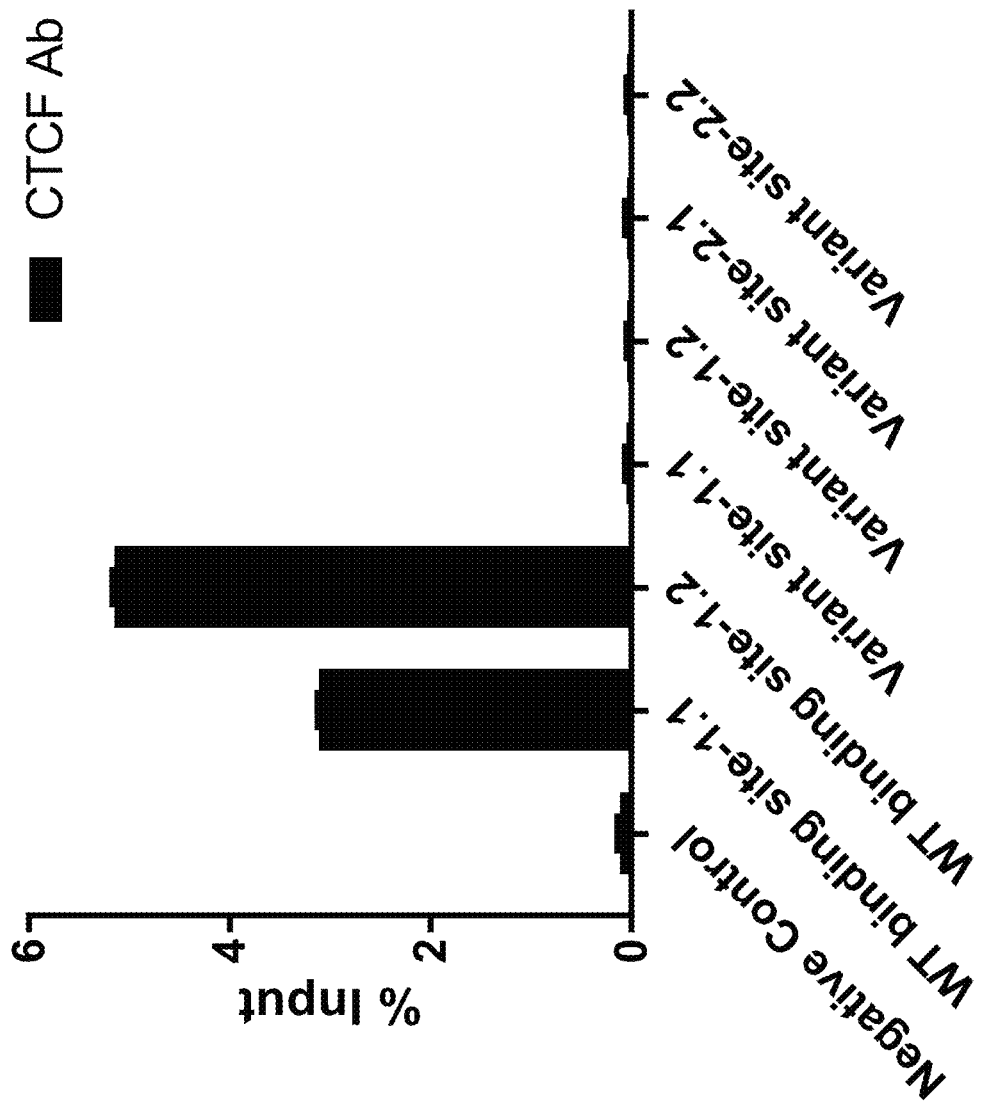
Figure 23A:
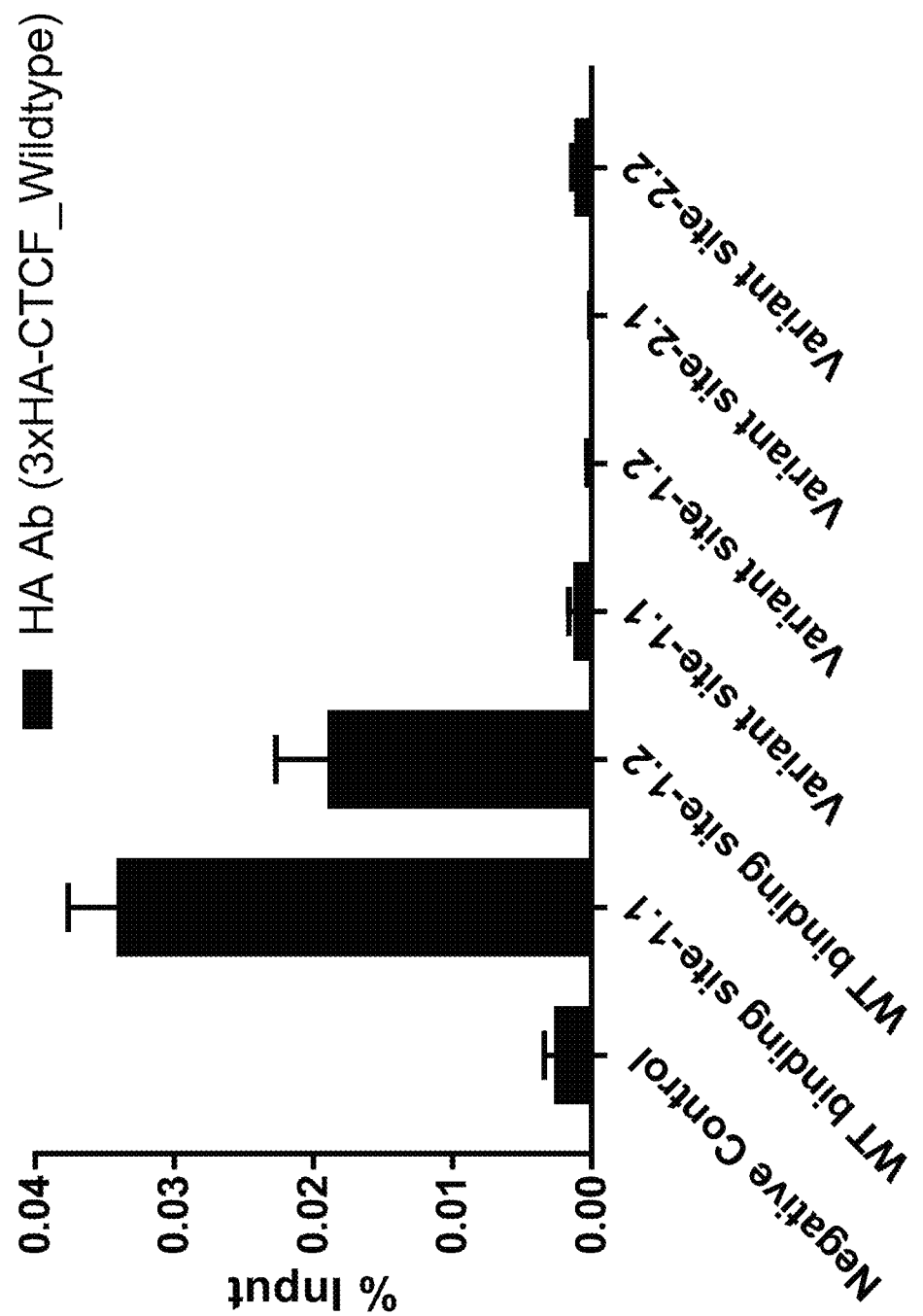
Figure 23B:
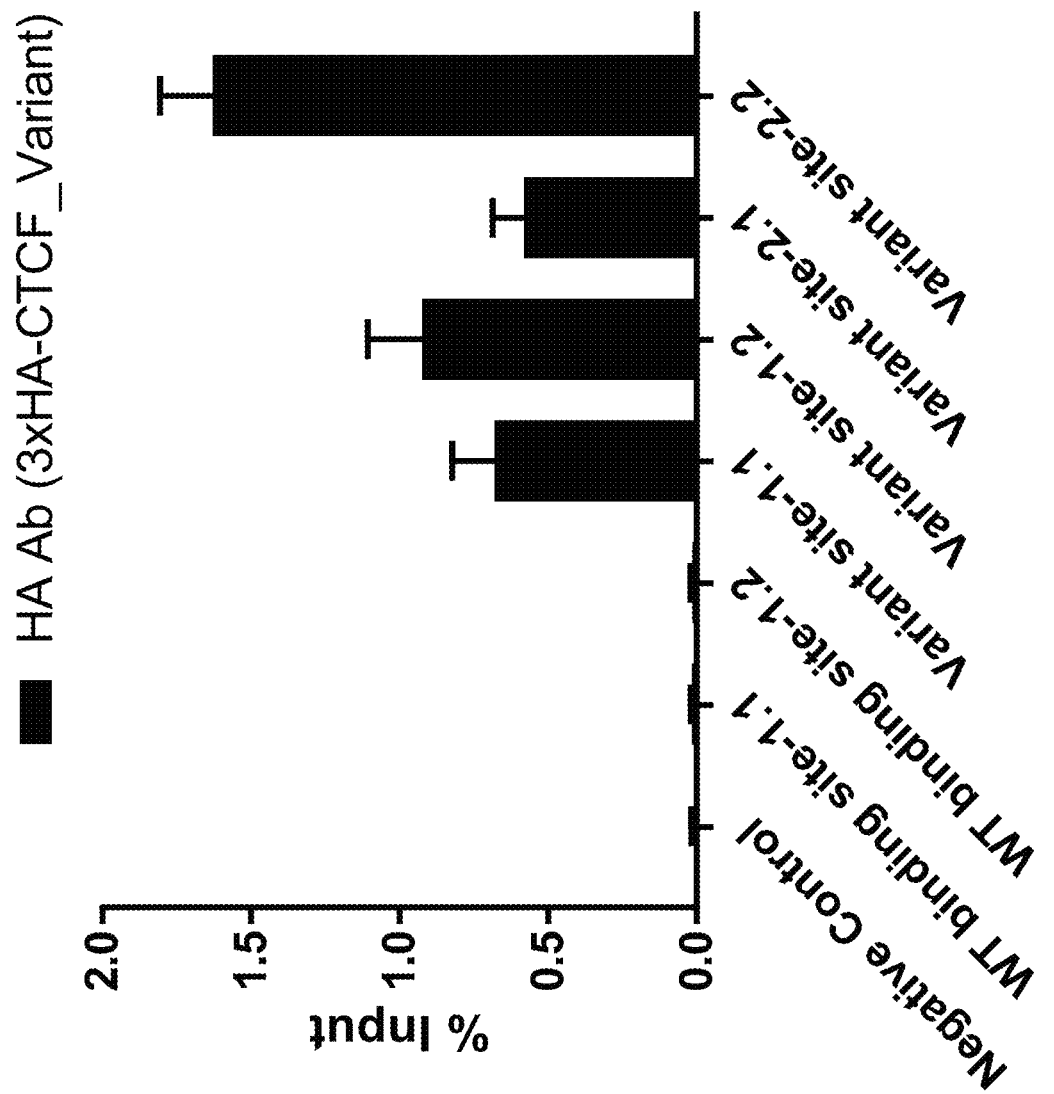

FIG. 22: Wild-type CTCF has binding activity to wild-type CTCF target site and no binding activity to two variant target sites. To confirm endogenous CTCF binds to the wild-type CBSs and not the variant binding sites, as seen in the B2H assay, in a human cell context, we harvested K562 cells, a human erythroleukemia cell line, and examined CTCF binding through ChIP-qPCR. CTCF was assayed for binding to a known CTCF target site and to two endogenous variant binding site sequences using a CTCF specific antibody to enrich for genomic DNA crosslinked to CTCF. Two sets of qPCR primers were designed for each binding site (indicated by 1.1, 1.2, etc). Binding was determined by enrichment of target site above 1% input of crosslinked and sonicated sample not treated with antibody, which is to represent the levels of the site of interest as a fold increase over the frequency of the site of interest in a sample unenriched with antibody. Antibody based enrichment of each sample is quantified by fold enrichment above untreated, and therefore unenriched, input. The negative control reflects background qPCR amplification levels of a target site that CTCF does not bind to. Anything above this negative level is considered enriched indicating CTCF binding while anything below is considered to not be unenriched, and therefore no binding by CTCF. Wild-type CTCF binds to the wild-type target site with no detectable binding to the variant binding sites as predicted by the bacterial B2H reporter assay FIGS. 23A-B: Exogenous wild-type and variant CTCF binding activity in human cells. Two endogenous variant binding site sequences, matching one of the five variant binding sites that CTCF variants were selected on, were identified in the human genome (Variant site 1 and Variant site 2). Both wild-type CTCF with a 3×HA tag and one of the 3×HA tagged engineered CTCF variants, selected to bind to the variant binding site sequence of Variant site 1 and Variant site 2, were assayed for binding in human cells through ChIP-qPCR. FIG. 23A: 3×HA tagged wild-type CTCF binds to wild-type CTCF binding site and does not bind to either variant binding site. Human K562 cells were transfected with plasmid expressing 3×HA tagged CTCF and processed with HA antibody to enrich specifically for the exogenous CTCF (3×HA tagged) and not endogenous CTCF (no tag) binding. A negative control is provided to show ChIP-qPCR levels with no enrichment for a region that is not occupied by CTCF. These results demonstrate exogenous wild-type CTCF has the same binding activity as endogenous CTCF. FIG. 23B: 3×HA tagged variant CTCF binds to variant binding sites and does not bind to wild-type CTCF binding site. K562 cells expressing variant CTCF tagged with 3×HA were analyzed by ChIP-qPCR and treated with HA specific antibody. The same sites as in FIGS. 22 and 23A were investigated for variant CTCF binding. The variant CTCF could bind to the variant sites as indicated by enrichment with variant specific HA antibody and no detectable binding was seen at the wild-type binding site as indicated by lack of HA antibody-based enrichment.

Figure 24A:
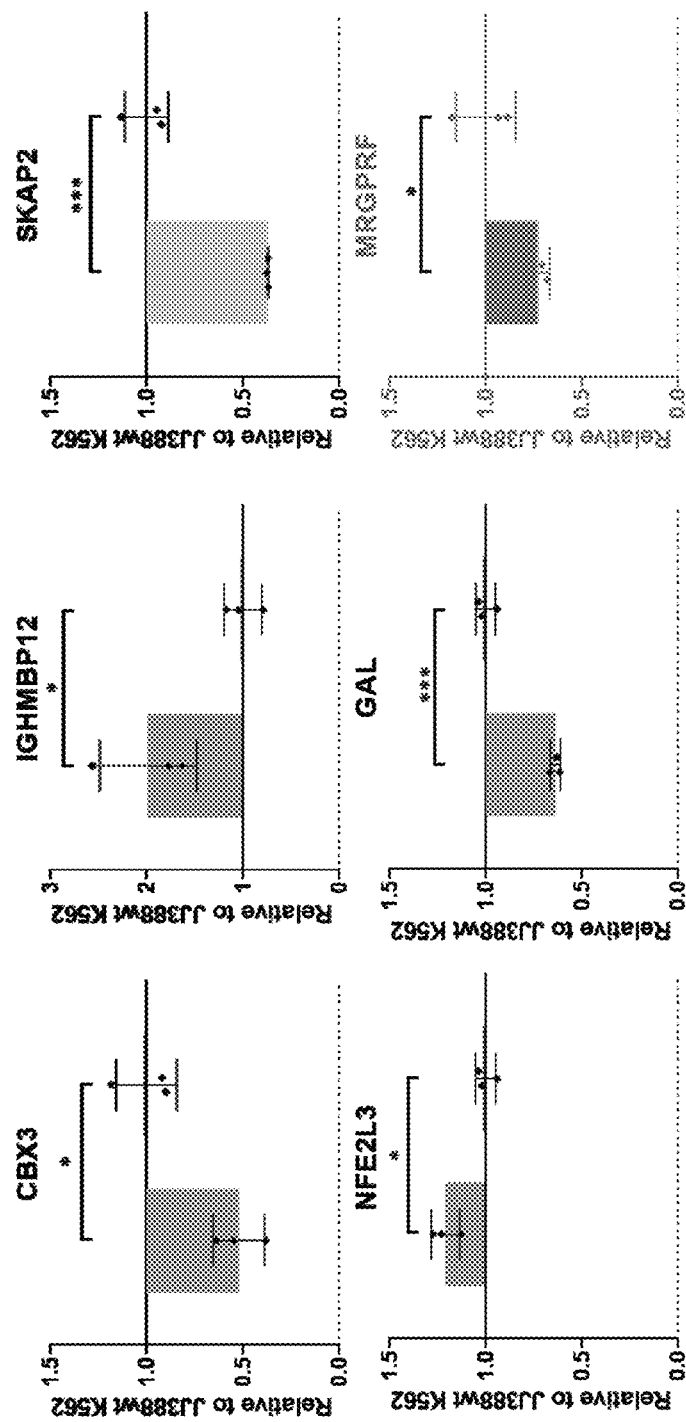
Figure 24B:
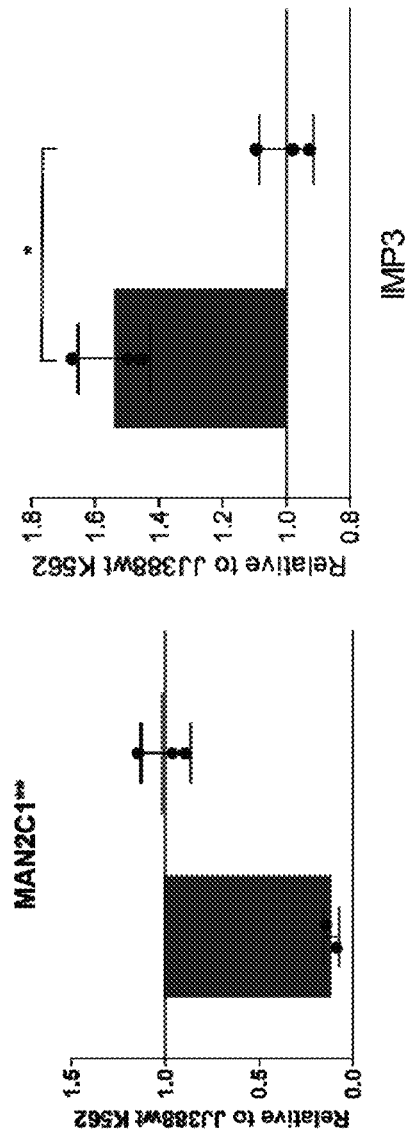

FIGS. 24A-B: Changes in gene expression relative to wild-type control of genes located around variant binding sites. A variant CTCF selected to the G3 binding site sequence and variant CTCF selected to the Other binding site sequence were expressed in wild-type K562s. The variant CTCFs were fused to GFP and RNA was isolated from GFP+ cells 72 hours post nucleofection. cDNA was generated from the RNA and quantified by RT-qPCR. Gene expression levels across samples were normalized to a house keeping gene (HPRT). Changes in gene expression are relative to gene expression levels in wild-type K562s expressing wild-type CTCF tagged with GFP. FIG. 24A. Changes in gene expression of genes around G3 variant binding site in the presence of variant CTCF relative to the wild-type CTCF control. FIG. 24B. Changes in gene expression of genes around Other variant binding site relative to the wild-type control.

Figure 25:
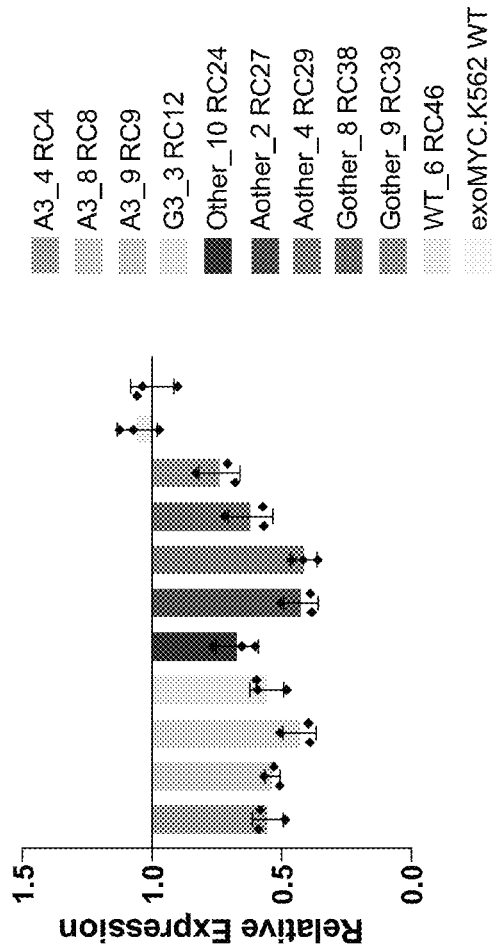

FIG. 25: Introduction of variant binding sites upstream of MYC leads to reduction of Endogenous MYC expression. The CTCF binding site ~2 kb upstream of the MYC TSS was replaced with one of six different sequences used for CTCF variant selections (listed in table). The introduction of these sequences with 4-6 nucleotide changes from the wild-type CTCF binding site sequence result in a reduction of endogenous MYC expression to the same levels as when the CTCF binding site is deleted and loop formation is disrupted. WT_6 sequence has 4 point mutations from the native CTCF binding site, but these changes should have no impact on wild-type CTCF binding as indicated by results from the B2H reporter assay. This appears to be the case as MYC expression levels in the WT_6 cell line are comparable to wild-type K562 MYC expression levels. Because K562 vitality is linked to MYC expression, all variant cell lines were generated in a K562 cell line with exogenous MYC expressed off of a separate PGK promoter (exoMYC.K562). FIG. 25 discloses SEQ ID NOS 5568-5573, respectively, in order of appearance.

Figure 26A:
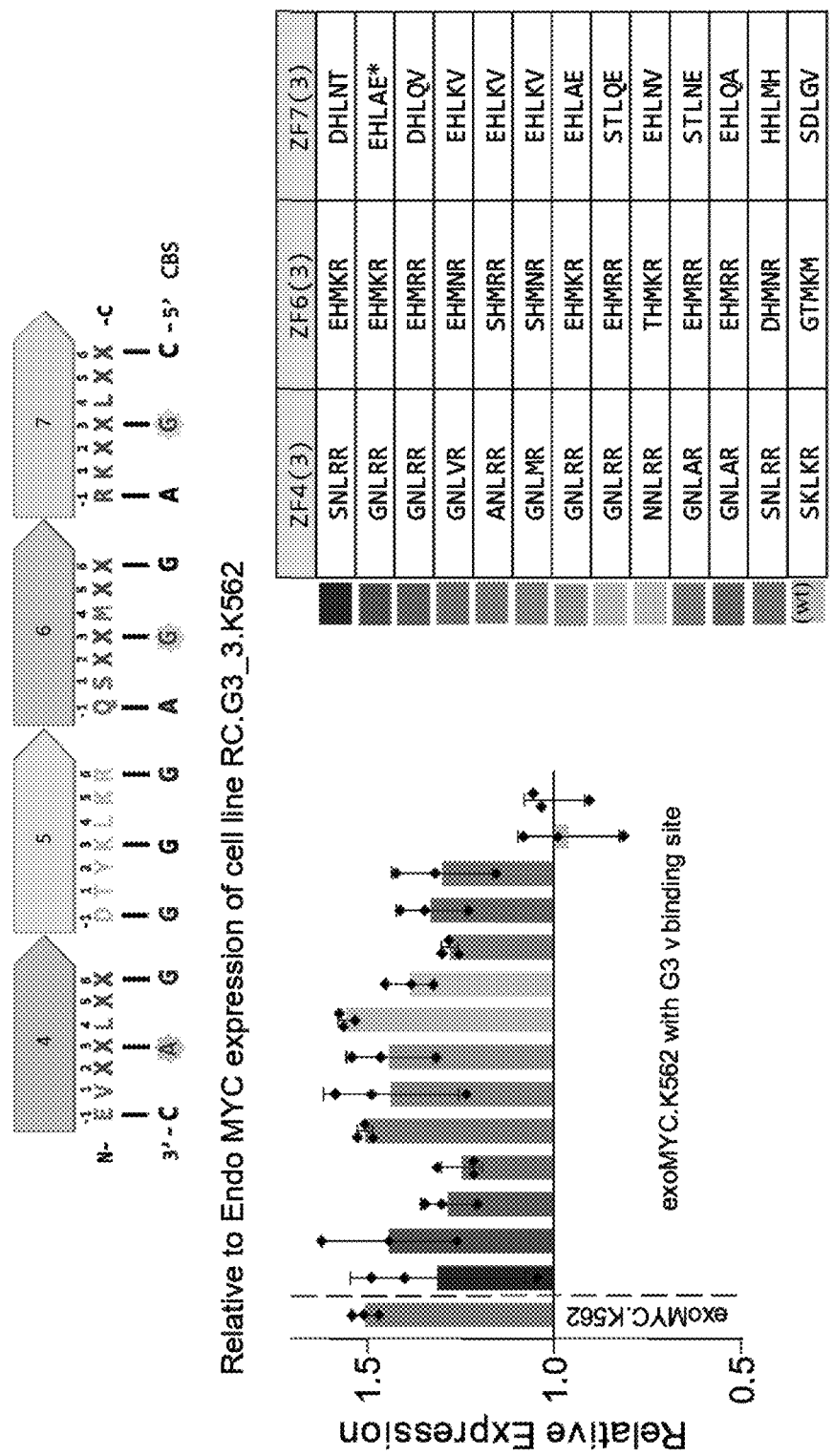
Figure 26B:
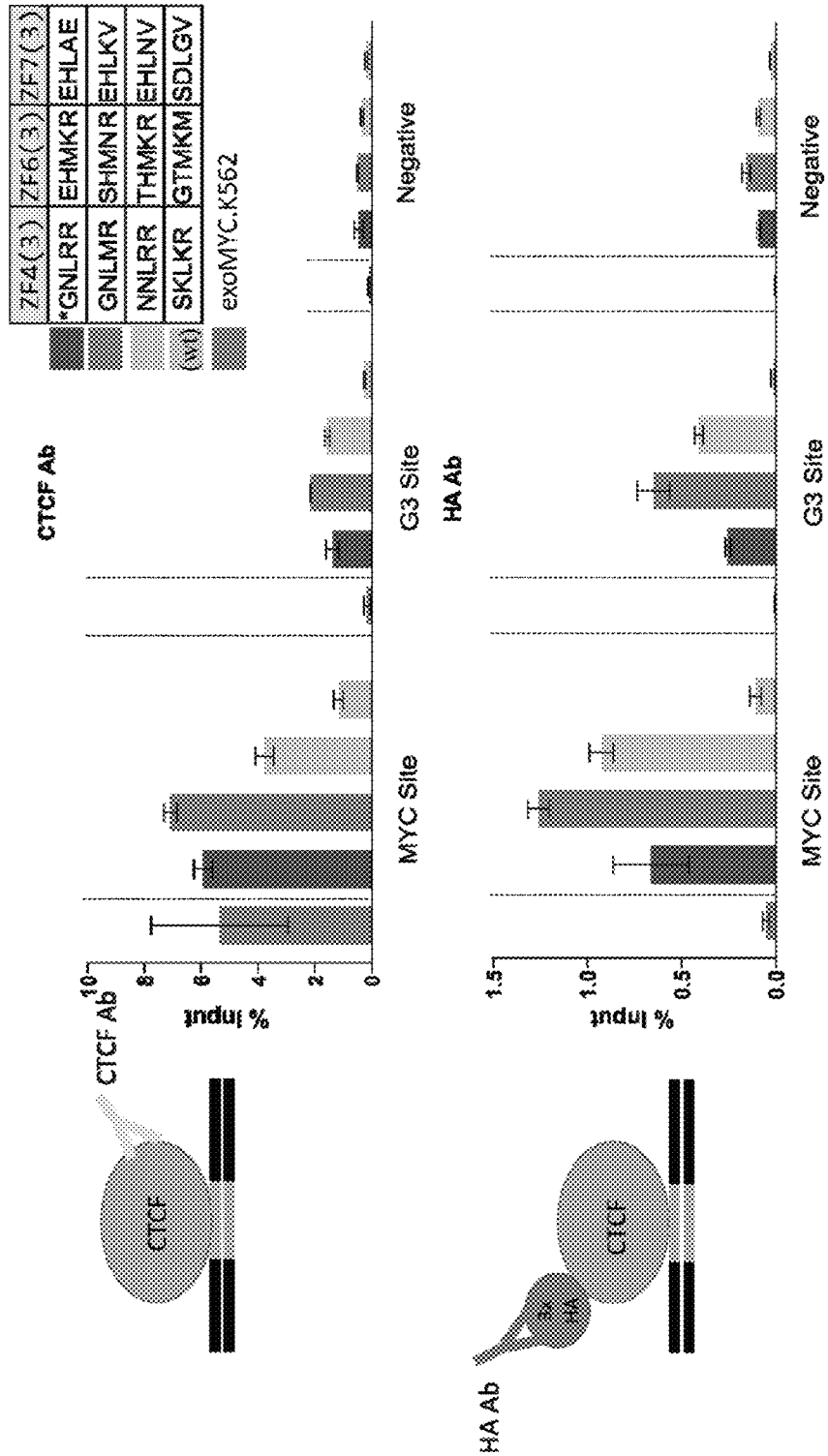

FIGS. 26A-B: Variant CTCFs are able to bind the engineered G3 variant binding site and recover MYC expression. CTCF variants selected to bind to the G3 variant binding site sequence were expressed in the G3_3.K562 cell line. Cells were analyzed for MYC expression and CTCF occupancy on the DNA 72 hours post nucleofection. Residues of ZF helix of the variant and wild-type (indicated by (wt) are listed in the legend. G3 binding site sequence and interacting recognition helix of the CTCF zinc finger array is also diagramed. FIG. 26A. Endogenous MYC levels are recovered to wild-type levels in the G3_3 cell line when CTCF variants are expressed. Endogenous MYC expression levels were quantified by RT-qPCR and are relative to reduced endogenous MYC levels of G3_3 cell line. Endogenous MYC levels from the exoMYC.K562 cell line without any alterations to the CTCF binding site is shown as a positive control (separated by dashed lines). FIG. 26B. CTCF variants are able to bind to the introduced variant binding site in G3_3 cell line while the wild-type CTCF does not. CTCF Ab specific enrichment captures both wild-type and variant CTCF while HA Ab will only detect HA-tagged CTCF (transiently expressed). exoMYC.K562 is included as a control for ChIP-qPCR and is separated by dashed line. exoMYC.K52 has the native sequence at the CTCF binding site upstream of MYC and should demonstrate wild-type CTCF binding. The exogenously expressed CTCFs (variant and wild-type) are HA tagged and expressed in the G3_3 cell line. ChIP-qPCR was performed to investigate CTCF binding to the variant CTCF site replacing the wild-type site ~2 kb upstream of MYC (MYC site). An endogenous G3 site elsewhere in the genome and a region with no known CTCF binding served as a positive and negative control respectively. The variant CTCFs are able to bind to the variant site as indicated by enrichment with both CTCF and HA antibody, while the wild-type CTCF does not. FIGS. 26A-B disclose "CAGGGGAGGAGC" as SEQ ID NO: 5564, "DTYKLKR" as SEQ ID NO: 3, "SNLRR" as SEQ ID NO: 116, "GNLRR" as SEQ ID NO: 118, "GNLVR" as SEQ ID NO: 117, "ANLRR" as SEQ ID NO: 69, "GNLMR" as SEQ ID NO: 139, "NNLRR" as SEQ ID NO: 121, "GNLAR" as SEQ ID NO: 138, "SKLKR" as SEQ ID NO: 3470, "EHMKR" as SEQ ID NO: 123, "EHMIRR" as SEQ ID NO: 34, "EHMNR" as SEQ ID NO: 126, "SHMRR" as SEQ ID NO: 147, "SHMNR" as SEQ ID NO: 146, "THMKR" as SEQ ID NO: 33, "DHMNR" as SEQ ID NO: 32, "GTMKM" as SEQ ID NO: 1255, "DHLNT" as SEQ ID NO: 155, "EHLAE" as SEQ ID NO: 151, "DHLQV" as SEQ ID NO: 12, "EHLKV" as SEQ ID NO: 13, "STLQE" as SEQ ID NO: 225, "EHLNV" as SEQ ID NO: 9, "STLNE" as SEQ ID NO: 152, "EHLQA" as SEQ ID NO: 156, "HHLMH" as SEQ ID NO: 157 and "SDLGV" as SEQ ID NO: 5552.

Figure 27A:
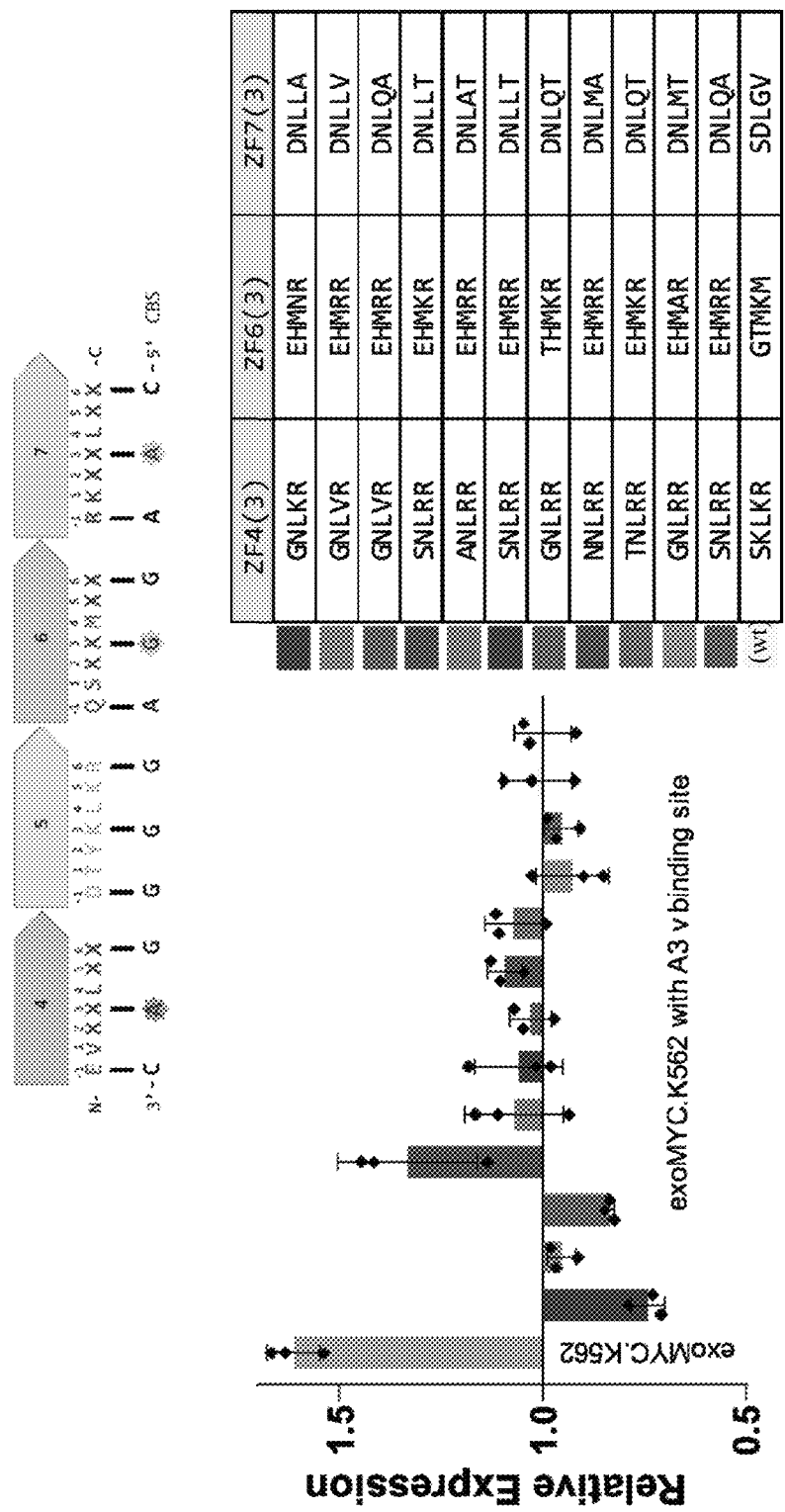
Figure 27B:
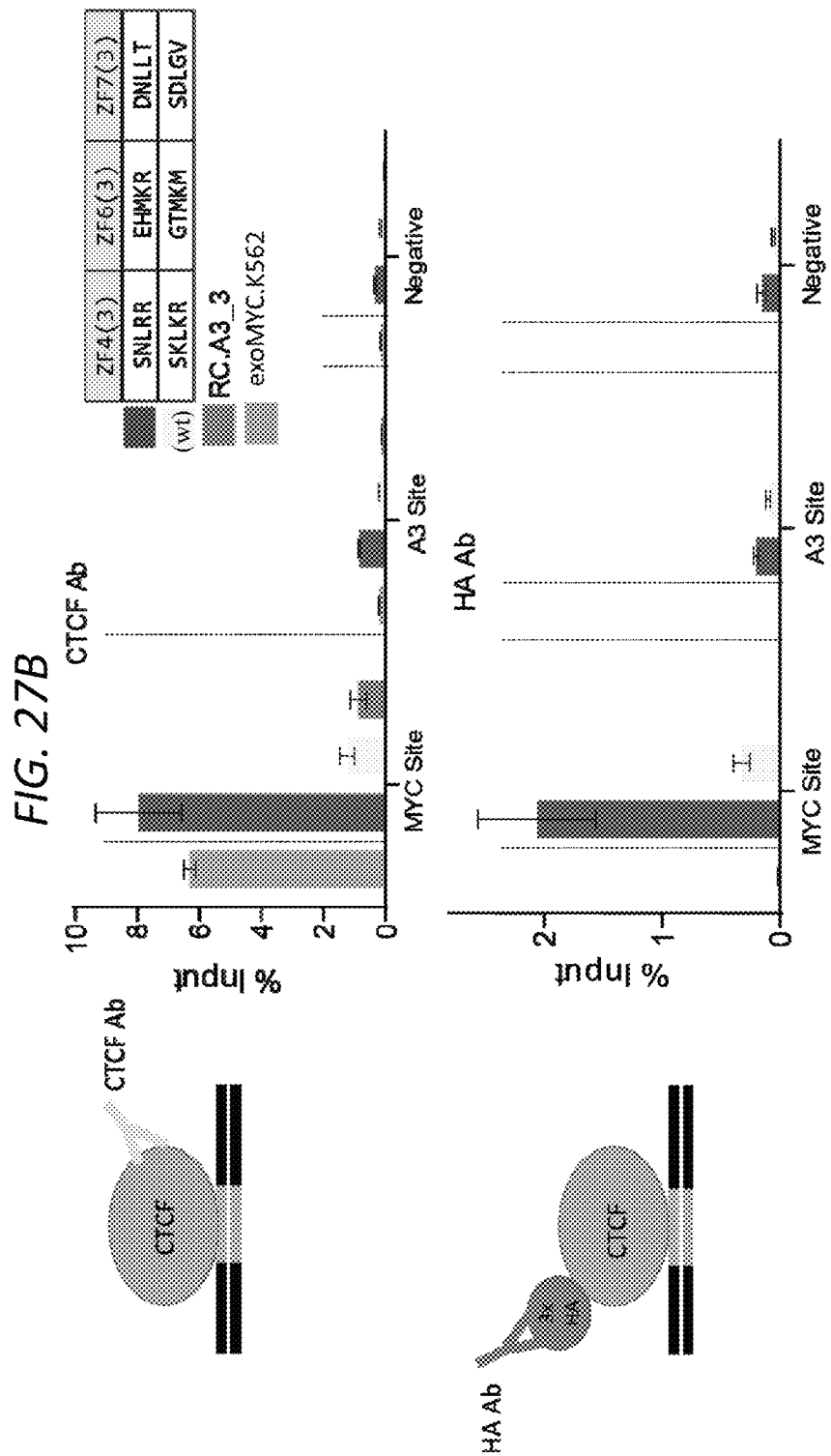

FIGS. 27A-B: Variant CTCFs are able to bind the engineered A3 variant binding site and recover MYC expression. CTCF variants selected to bind to the A3 variant binding site sequence were expressed in the A3_4.K562 cell line. Cells were analyzed for MYC expression and CTCF occupancy on the DNA 72 hours post nucleofection. Residues of ZF helix of the variant and wild-type (indicated by (wt) are listed in the legend. A3 binding site sequence and interacting recognition helix of the CTCF zinc finger array is also diagramed. FIG. 27A. Endogenous MYC levels are recovered to wild-type levels in the A3_4 cell line when CTCF variants are expressed. Endogenous MYC expression levels were quantified by RT-qPCR and are relative to reduced endogenous MYC levels of A3_4 cell line. Endogenous MYC levels from the exoMYC.K562 cell line without any alterations to the CTCF binding site is shown as a positive control (separated by dashed lines). FIG. 27B. CTCF variants are able to bind to the introduced variant binding site in A3_4 cell line while the wild-type CTCF does not. CTCF Ab specific enrichment captures both wild-type and variant CTCF while HAAb will only detect HA-tagged CTCF (transiently expressed). exoMYC.K562 is included as a control for ChIP-qPCR and is separated by dashed line. exoMYC.K52 has the native sequence at the CTCF binding site upstream of MYC and should demonstrate wild-type CTCF binding. The exogenously expressed CTCFs (variant and wild-type) are HA tagged and expressed in the A3_4 cell line. ChIP-qPCR was performed to investigate CTCF binding to the variant CTCF site replacing the wild-type site ~2 kb upstream of MYC (MYC site). An endogenous A3 site elsewhere in the genome and a region with no known CTCF binding served as a positive and negative control respectively. The variant CTCFs are able to bind to the variant site as indicated by enrichment with both CTCF and HA antibody above the negative control, while the wild-type CTCF does not bind. FIGS. 27A-B disclose "CAGGGGAGGAAC" as SEQ ID NO: 5562, "DTYKLKR" as SEQ ID NO: 3, "GNLKR" as SEQ ID NO: 119, "GNLVR" as SEQ ID NO: 117, "SNLRR" as SEQ ID NO: 116, "ANLRR" as SEQ ID NO: 69, "GNLRR" as SEQ ID NO: 118, "NNLRR" as SEQ ID NO: 121, "TNLRR" as SEQ ID NO: 68, "SKLKR" as SEQ ID NO: 3470, "EHMNR" as SEQ ID NO: 126, "EHMIRR" as SEQ ID NO: 34, "EHMKR" as SEQ ID NO: 123, "THMKR" as SEQ ID NO: 33, "EHMAR" as SEQ ID NO: 127, "GTMKM" as SEQ ID NO: 1255, "DNLLA" as SEQ ID NO: 100, "DNLLV" as SEQ ID NO: 129, "DNLQA" as SEQ ID NO: 133, "DNLLT" as SEQ ID NO: 128, "DNLAT" as SEQ ID NO: 132, "DNLQT" as SEQ ID NO: 130, "DNLMA" as SEQ ID NO: 102, "DNLMT" as SEQ ID NO: 135 and "SDLGV" as SEQ ID NO: 5552.

Figure 28:
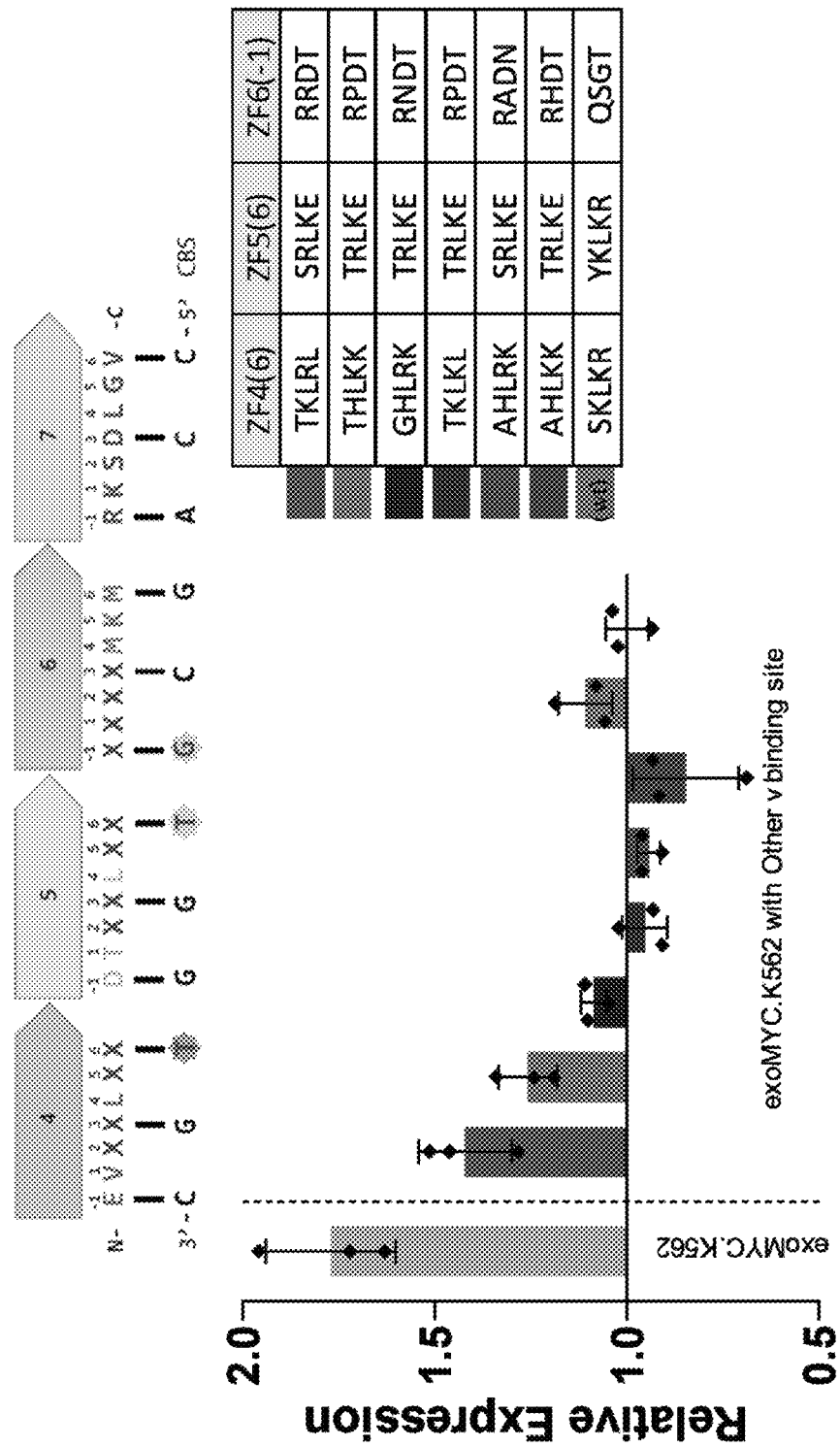

FIG. 28: Variant CTCFs recover MYC expression of the Other 10 variant binding site cell line. CTCF variants selected to bind to the Other variant binding site sequence were expressed in the Other 10.K562 cell line. Cells were analyzed for MYC expression 72 hours post nucleofection. Residues of ZF helix of the variant and wild-type CTCFs (indicated by (wt) are listed in the legend. Other binding site sequence and interacting recognition helix of the CTCF zinc finger array is also diagramed. A. Endogenous MYC levels are recovered to wild-type levels in the Other 10 cell line when CTCF variants are expressed. Endogenous MYC expression levels were quantified by RT-qPCR and are relative to reduced endogenous MYC levels of Other 10 cell line. Endogenous MYC levels from the exoMYC.K562 cell line without any alterations to the CTCF binding site is shown as a positive control (separated by dashed lines). FIG. 28 discloses "RKSDLGV" as SEQ ID NO: 5, "CGTGGTGCGACC" as SEQ ID NO: 5574, "TKLRL" as SEQ ID NO: 160, "THLKK" as SEQ ID NO: 163, "GHLRK" as SEQ ID NO: 162, "TKLKL" as SEQ ID NO: 161, "AHLRK" as SEQ ID NO: 60, "AHLKK" as SEQ ID NO: 159, "SKLKR" as SEQ ID NO: 3470, "SRLKE" as SEQ ID NO: 44, "TRLKE" as SEQ ID NO: 165, "YKLKR" as SEQ ID NO: 5553, "RRDT" as SEQ ID NO: 169, "RPDT" as SEQ ID NO: 38, "RNDT" as SEQ ID NO: 172, "RADN" as SEQ ID NO: 167, "RHDT" as SEQ ID NO: 40 and "QSGT" as SEQ ID NO: 1582.

Figure 29:
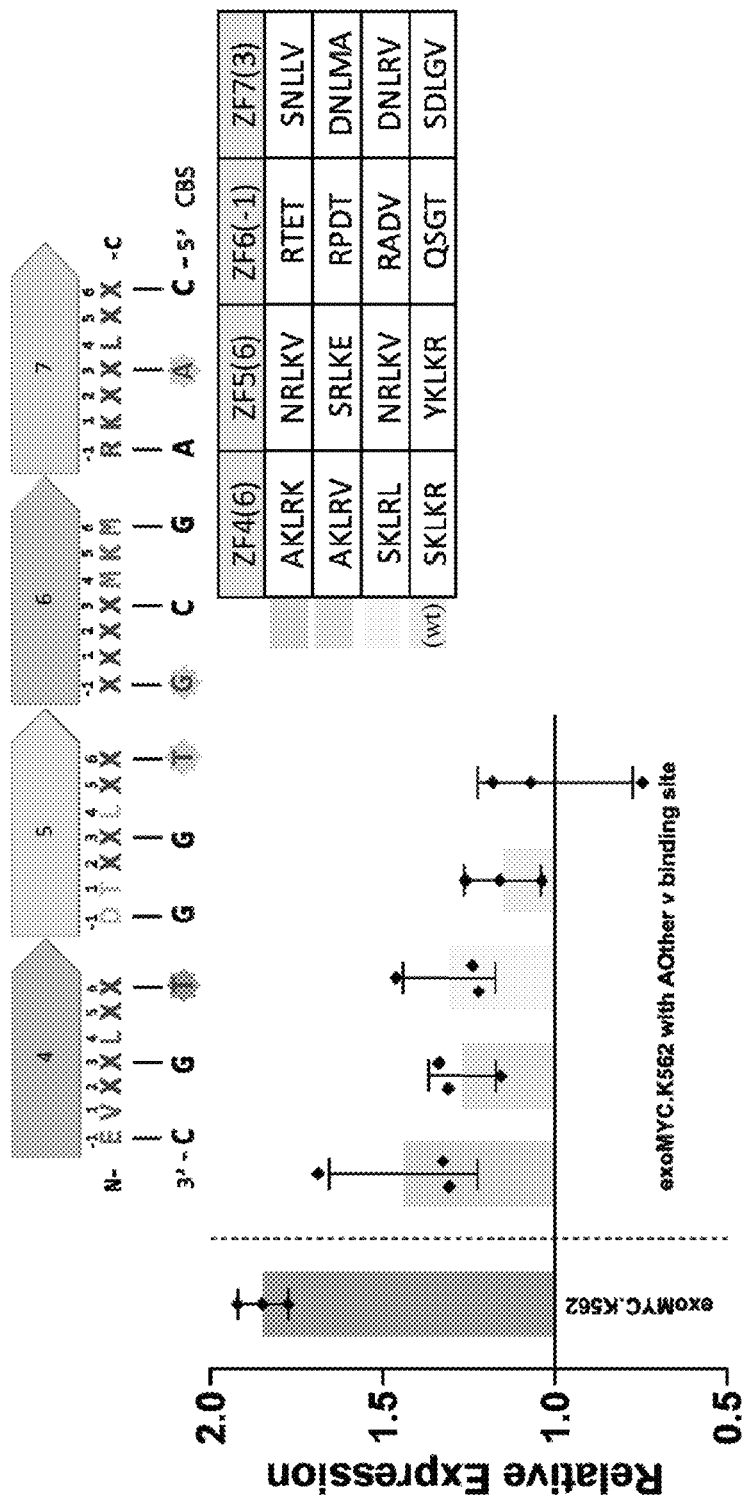

FIG. 29: Variant CTCFs recover MYC expression of the Aother_2 variant binding site cell line. CTCF variants selected to bind to the Aother variant binding site sequence were expressed in the Aother_2.K562 cell line. Cells were analyzed for MYC expression 72 hours post nucleofection. Residues of ZF helix of the variant and wild-type CTCFs (indicated by (wt) are listed in the legend. Aother binding site sequence and interacting recognition helix of the CTCF zinc finger array is also diagramed. A. Endogenous MYC levels are recovered to wild-type levels in the Aother_2 cell line when CTCF variants are expressed. Endogenous MYC expression levels were quantified by RT-qPCR and are relative to reduced endogenous MYC levels of Aother_2 cell line. Endogenous MYC levels from the exoMYC.K562 cell line without any alterations to the CTCF binding site is shown as a positive control (separated by dashed lines). FIG. 29 discloses "CGTGGTGCGAAC" as SEQ ID NO: 5575, "AKLRK" as SEQ ID NO: 89, "AKLRV" as SEQ ID NO: 61, "SKLRL" as SEQ ID NO: 92, "SKLKR" as SEQ ID NO: 3470, "NRLKV" as SEQ ID NO: 94, "SRLKE" as SEQ ID NO: 44, "YKLKR" as SEQ ID NO: 5553, "RTET" as SEQ ID NO: 98, "RPDT" as SEQ ID NO: 38, "RADV" as SEQ ID NO: 99, "QSGT" as SEQ ID NO: 1582, "SNLLV" as SEQ ID NO: 101, "DNLMA" as SEQ ID NO: 102, "DNLRV" as SEQ ID NO: 103 and "SDLGV" as SEQ ID NO: 5552.

DETAILED DESCRIPTION

To date, there are no engineered CTCF variants available that are designed to bind to mutant CBSs with higher affinity than wild-type CTCF. Therefore, there is a need for engineered CTCF variants that can bind to mutant CBSs with higher affinity than wild-type CTCF.

The present disclosure is based, at least in part, on the discovery that CTCF variants with alterations in the zinc finger array can be engineered to recognize CBSs that harbor one or more point mutations, i.e., mutant CBSs.

CTCF

CCCTC-binding factor (CTCF) is a multi-domain protein that acts as an essential genome organizer by maintaining higher-order chromatin structure while also having a role in cell differentiation and the promotion or repression of gene expression. CTCF maintains topologically associated domains (TADs) spanning megabases of the genome as well as smaller scale Sub-TADs leading to fine-tuned gene insulation or gene activation within gene clusters. In addition, CTCF has been found to regulate mRNA splicing by influencing the rate of transcription and more recently been implicated in promoting homologous recombination repair at double-strand breaks. Wild type CTCF binds throughout the genome via an 11 finger zinc finger array that recognizes canonical CTCF binding sites (CBSs).

Wild-type CTCF ZF arrays comprise the following sequences at ZFs 3-6 positions −1 to +6:

```
                                          (SEQ ID NO: 1)
    ZF3 positions -1 to +6: TSGELVR (SEQ ID NO: 2)
    ZF4 positions -1 to +6: EVSKLKR (SEQ ID NO: 3)
    ZF5 positions -1 to +6: DTYKLKR (SEQ ID NO: 4)
    ZF6 positions -1 to +6: QSGTMKM (SEQ ID NO: 5)
    ZF7 positions -1 to +6: RKSDLGV
```

A wild-type CTCF has an amino acid sequence that has greater than 80%, greater than 85%, greater than 90%, greater than 95%, greater than 96%, greater than 97%, greater than 98% or greater than 99% sequence identity as compared to the amino acid sequence shown below:

```
                                        (SEQ ID NO: 190)
MEGDAVEAIVEESETFIKGKERKTYQRRREGGQEEDACHLPQNQTDGGEV

VQDVNSSVQMVMMEQLDPTLLQMKTEVMEGTVAPEAEAAVDDTQIITLQV

VNMEEQPINIGELQLVQVPVPVTVPVATTSVEELQGAYENEVSKEGLAES

EPMICHTLPLPEGFQVVKVGANGEVETLEQGELPPQEDPSWQKDPDYQPP

AKKTKKTKKSKLRYTEEGKDVDVSVYDFEEEQQEGLLSEVNAEKVVGNMK

PPKPTKIKKKGVKKTFQCELCSYTCPRRSNLDRHMKSHTDERPHKCHLCG

RAFRTVTLLRNHLNTHTGTRPHKCPDCDMAFVTSGELVRHRRYKHTHEKP

FKCSMCDYASVEVSKLKRHIRSHTGERPFQCSLCSYASRDTYKLKRHMRT

HSGEKPYECYICHARFTQSGTMKMHILQKHTENVAKFHCPHCDTVIARKS

DLGVHLRKQHSYIEQGKKCRYCDAVFHERYALIQHQKSHKNEKRFKCDQC

DYACRQERHMIMHKRTHTGEKPYACSHCDKTFRQKQLLDMHFKRYHDPNF

VPAAFVCSKCGKTFTRRNTMARHADNCAGPDGVEGENGGETKKSKRGRKR

KMRSKKEDSSDSENAEPDLDDNEDEEEPAVEIEPEPEPQPVTPAPPPAKK

RRGRPPGRTNQPKQNQPTAIIQVEDQNTGAIENIIVEVKKEPDAEPAEGE

EEEAQPAATDAPNGDLTPEMILSMMDR
```

For the purpose of comparing two different nucleic acid or polypeptide sequences, one sequence (test sequence) may be described to be a specific percentage identical to another sequence (comparison sequence). The percentage identity can be determined by the algorithm of Karlin and Altschul, Proc. Natl. Acad. Sci. USA, 90:5873-5877 (1993), which is incorporated into various BLAST programs. The percentage identity can be determined by the "BLAST 2 Sequences" tool, which is available at the National Center for Biotechnology Information (NCBI) website. See Tatusova and Madden, FEMS Microbiol. Lett., 174(2):247-250 (1999). For pairwise DNA-DNA comparison, the BLASTN program is used with default parameters (e.g., Match: 1; Mismatch: −2; Open gap: 5 penalties; extension gap: 2 penalties; gap x_dropoff: 50; expect: 10; and word size: 11, with filter). For pairwise protein-protein sequence comparison, the BLASTP program can be employed using default parameters (e.g., Matrix: BLOSUM62; gap open: 11; gap extension: 1; x_dropoff: 15; expect: 10.0; and wordsize: 3, with filter).

Percent identity of two sequences is calculated by aligning a test sequence with a comparison sequence using BLAST, determining the number of amino acids or nucleotides in the aligned test sequence that are identical to amino acids or nucleotides in the same position of the comparison sequence, and dividing the number of identical amino acids or nucleotides by the number of amino acids or nucleotides in the comparison sequence. When BLAST is used to compare two sequences, it aligns the sequences and yields the percent identity over defined, aligned regions. If the two sequences are aligned across their entire length, the percent identity yielded by the BLAST is the percent identity of the two sequences. If BLAST does not align the two sequences over their entire length, then the number of identical amino acids or nucleotides in the unaligned regions of the test sequence and comparison sequence is considered to be zero and the percent identity is calculated by adding the number of identical amino acids or nucleotides in the aligned regions and dividing that number by the length of the comparison sequence. Various versions of the BLAST programs can be used to compare sequences, e.g., BLAST 2.1.2 or BLAST+ 2.2.22.

CTCF Binding Sites (CBSs)

Figure 1:
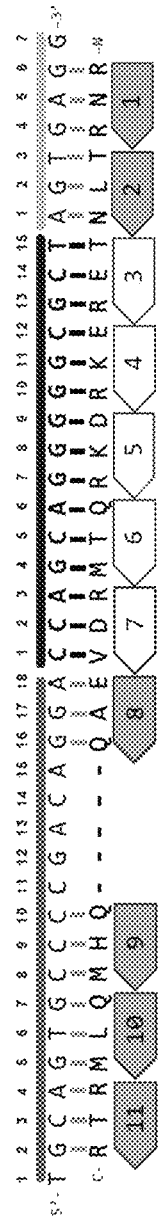
FIG. 1: Diagram of an exemplary 11-finger CTCF zinc finger array protein-DNA interactions at the CTCF binding site. Each zinc finger of the 11-finger array contained a recognition alpha-helix where protein-DNA base contacts were made by amino acids in position −1, 2, 3 and 6 of each alpha-helix. Here, position −1, 3, and 6 were only depicted as positon 2 makes a cross strand contact with the opposite strand of the binding site that is not shown here. The sequence for the binding site was derived from ChIP-seq data (Nakahashi et al., 2013). The binding site was partitioned into three segments: 5' flanking (gray-line), core (black-line), and 3' flanking (light gray line). The position of each nucleotide within each segment are numbered. Dashes indicate known DNA-protein contacts (black) and theoretical DNA-protein contacts (gray) between the zinc finger array and the binding site. Zinc fingers 3-7 of the array (white) make protein-DNA contacts with the core sequence (bold, black lined). There was a possible 5-6 base pair gap (represented by horizontal dashed lines) between zinc finger 8 and zinc fingers 9-11 as suggested by ChIP-exo and DNAse I footprinting of CTCF bound DNA fragments (Hashimoto, H. et al., 2017). Note CTCF binds to its target site in the 3'-5' direction with the N-terminal side of the protein binding to the 3' end of the binding site.

The CBS is typically 40 bp in length with a highly conserved 15 bp core sequence (or core motif). Sequence flanking the core sequence is significantly less well conserved, but still important for CTCF binding at sites throughout the genome (FIG. 1).

Wild type CTCF binds to a "consensus CBS motif" contains the following core sequence: 5'-NCDNHN-GRNGDNNNN-3' (SEQ ID NO: 191).

In one embodiment, the consensus CBS motif contains the following core sequence: 5'-CCAGCAGGGGGCGCT-3' (SEQ ID NO:6). Other core sequences that are known in the art.

It is not known if the nucleotides flanking the core sequence are bound by the 11 finger ZF array present within CTCF. Co-crystal structures of the 11-finger Zinc Finger (ZF) array bound to a consensus CTCF Binding Sequence (CBS) suggests that only ZFs 3-7 of the 11-finger ZF array appear to bind directly to the highly conserved core sequence while ZFs 8-11 and 1-2 do not appear to mediate sequence-specific contacts. Progressive truncations of the ZF array suggest that ZFs 8-11 and ZFs 1-2 may improve DNA-binding of CTCF to CBSs and DNaseI foot printing, as well as ChIP-Seq and ChIP-Exo data, suggests that ZFs 9-11 may make important protein-DNA contacts (Rhee and Pugh, Cell (2011); Nakahashi et al., Cell Reports (2013)). Interestingly, the co-crystal structure of the CTCF Z array bound to a CBS only contains zinc finger 2-9 with the other fingers not visible in the structure, consistent with the idea that zinc fingers interacting with flanking regions of the motif may not make stable contacts with the DNA (Hashimoto, et al., Molecular Cell (2017)). Thus, it remains unclear what impact all 11 fingers of the array have on DNA binding activity of CTCF and if all zinc fingers, or a subset, contact the DNA.

CTCF binding is sensitive to changes in the conserved 15 bp core motif of the CBS, where, in mice, single nucleotide changes at certain positions can lead to loss of CTCF binding (Nakahashi et al., Cell Reports (2013)). CTCF binding sites have been reported to be mutational hotspots in cancer with cancer-associated mutations localized to the core sequence of the CTCF binding site in primary samples from gastrointestinal cancer patients and with accompanying atypical gene expression profiles of oncogenic and tumor suppressor genes (Guo et al., Nature Communications (2018)). Small deletions of CTCF binding sites have also been shown to lead to loss of expression of genes such as MYC and PTGS2, which both play a role in cancer development (Schuijers et al., Cell Reports (2018); Kang et al., Oncogene (2015)).

Methods described herein can be used to select and generate engineered CTCF variants comprising a plurality of zinc fingers, where the selected polypeptide has at least one amino acid residue in at least one zinc finger that differs in sequence from a wild-type CTCF, and where the engineered CTCF variant binds to a DNA sequence of interest (e.g., CBS harboring at least one mutation in the consensus CBS sequence) but does not bind to a consensus CBS. Using methods of the present invention, a scaffold polypeptide is re-engineered into a new scaffold-based zinc-finger polypeptide that has different structural and functional features, such that the new polypeptide binds to a sequence of interest but does not bind to a naturally occurring DNA binding site of the scaffold protein.

The term "zinc finger" or "Zf" refers to a polypeptide having DNA binding domains that are stabilized by zinc. The individual DNA binding domains are typically referred to as "fingers." A Zf protein has at least one finger, preferably 2 fingers, 3 fingers, or 6 fingers. A Zf protein having two or more Zfs is referred to as a "multi-finger" or "multi-Zf" protein. Each finger typically comprises an approximately 30 amino acid, zinc-chelating, DNA-binding domain. An exemplary motif characterizing one class of these proteins is -Cys-(X) (2-4)-Cys-(X) (12)-His-(X) (3-5)-His (SEQ ID NO:7), where X is any amino acid, which is known as the "C(2)H(2)class." A single Zf of this class typically consists of an alpha helix containing the two invariant histidine residues co-ordinated with zinc along with the two cysteine residues.

The term "bind to" or "binding" with respect to a nucleic acid binding factor and its target nucleic acid, e.g., CTCF (variant or wild-type) and CBS, refers to sequence-dependent binding of the nucleic acid binding factor to the target nucleic acid sequence of a nucleic acid through intermolecular interactions, e.g., ionic, covalent, London dispersion, dipole-dipole, or hydrogen bonding, in such a way that the binding allows the nucleic acid binding factor to mediate a biologically significant function, e.g., transcriptional activation, recruitment of other proteins to the binding site, and/or alteration of chromatic structure. Such binding can result in modulation of expression of genes, such as activation, overexpression, suppression, or inactivation of gene expression.

The term "does not bind to" with respect to a nucleic acid binding factor and its target nucleic acid, e.g., CTCF (variant or wild-type) and CBS, refers to the lack of sequence-specific binding of the nucleic acid binding factor to a nucleic acid through intermolecular interactions, e.g., ionic, covalent, London dispersion, dipole-dipole, or hydrogen bonding, as a result of the lack of presence of a target sequence in the nucleic acid (e.g., due to one or more point-mutations in the CBS). Such non-binding does not allow the nucleic acid binding factor to mediate a biologically significant function, e.g., transcriptional activation, DNA modification, DNA cleavage, recruitment of other proteins to the binding site, and/or alteration of chromatic structure.

Each finger within a Zf protein binds to from about two to about five base pairs within a DNA sequence. Typically a single Zf within a Zf protein binds to a three or four base pair "subsite" within a DNA sequence. Accordingly, a "subsite" is a DNA sequence that is bound by a single zinc finger. A "multi-subsite" is a DNA sequence that is bound by more than one zinc finger, and comprises at least 4 bp, preferably 6 bp or more. A multi-Zf protein binds at least two, and typically three, four, five, six or more subsites, i.e., one for each finger of the protein.

Compositions and Methods

Described herein are engineered CTCF variants that can bind to mutant CBSs with higher affinity than wild-type CTCF. The engineered CTCF variants can be used in regulating genes that are under the control of mutant CBSs (CBSs having at least one nucleic acid that is different in sequence from the nucleic acid sequence of a consensus CBS). The CTCF variants have at least one amino acid residue in at least one zinc finger that differs in sequence from the amino acid sequence of a wild-type CTCF.

Exemplary engineered CTCF variants include those that contain:

(1) the amino acid sequence DHLQT (SEQ ID NO:8), EHLNV (SEQ ID NO:9), AHLQV (SEQ ID NO:10), EHLRE (SEQ ID NO:11), DHLQV (SEQ ID NO:12), EHLKV (SEQ ID NO:13), DHLQV (SEQ ID NO:14), EHLVV (SEQ ID NO:15), DHLRT (SEQ ID NO:16), DHLAT (SEQ ID NO:17), or DHLQT (SEQ ID NO:18) at ZF7 positions +2 to +6;

(2) the amino acid sequence DHLQT (SEQ ID NO:19), EHLNV (SEQ ID NO:20), AHLQV (SEQ ID NO:21), EHLRE(SEQ ID NO:22), DHLQV (SEQ ID NO:23), EHLKV (SEQ ID NO:24), DHLQV (SEQ ID NO:25), EHLVV (SEQ ID NO:26), DHLRT (SEQ ID NO:27), DHLAT (SEQ ID NO:28), or DHLQT (SEQ ID NO:29) at ZF7 positions +2 to +6;

(3) the amino acid sequence NAMKR (SEQ ID NO:30), EHMGR (SEQ ID NO:31), DHMNR (SEQ ID NO:32), THMKR (SEQ ID NO:33), EHMRR (SEQ ID NO:34), or THMNR (SEQ ID NO:35) at ZF6 positions +2 to +6;

(4) the amino acid sequence MNES (SEQ ID NO:36), HRES (SEQ ID NO:37), RPDT (SEQ ID NO:38), RTDI (SEQ ID NO:39), or RHDT (SEQ ID NO:40) at ZF6 positions −1 to +3;

(5) the amino acid sequence HGLKV (SEQ ID NO:41), HRLKE (SEQ ID NO:42), HALKV (SEQ ID NO:43), SRLKE (SEQ ID NO:44), DGLRV (SEQ ID NO:45), HTLKV (SEQ ID NO:46), or NRLKE (SEQ ID NO:47) at ZF5 positions +2 to +6;

(6) the amino acid sequence ATLKR (SEQ ID NO:48), QALRR (SEQ ID NO:49), GGLVR (SEQ ID NO:50), HGLIR (SEQ ID NO:51), ANLSR (SEQ ID NO:52), TGLTR (SEQ ID NO:53), HGLVR (SEQ ID NO:54), GGLTR(SEQ ID NO:55), HTLRR(SEQ ID NO:56), TVLKR (SEQ ID NO:57), ADLKR (SEQ ID NO:58), or HGLRR (SEQ ID NO:59) at ZF5 positions +2 to +6;

(7) the amino acid sequence AHLRK (SEQ ID NO:60), AKLRV (SEQ ID NO:61), GGLGL (SEQ ID NO:62), AKLRI (SEQ ID NO:63), TKLKV (SEQ ID NO:64), or SKLRV (SEQ ID NO:65) at ZF4 positions +2 to +6;

(8) the amino acid sequence ATLRR (SEQ ID NO:66), RRLDR (SEQ ID NO:67), TNLRR (SEQ ID NO:68), ANLRR (SEQ ID NO:69), GNLTR (SEQ ID NO:70), AMLKR (SEQ ID NO:71), HMLTR (SEQ ID NO:72), AMLRR (SEQ ID NO:73), or TMLRR (SEQ ID NO:74) at ZF4 positions +2 to +6;

(9) the amino acid sequence QQLIV (SEQ ID NO:75), SQLIV (SEQ ID NO:76), QQLLV (SEQ ID NO:77), GELVV (SEQ ID NO:78), QQLLI (SEQ ID NO:79), GQLIV (SEQ ID NO:80), GQLTV (SEQ ID NO:81), TELII (SEQ ID NO:82), QGLLV (SEQ ID NO:83), QQLLT (SEQ ID NO:84), GQLLT (SEQ ID NO:85), GELLT (SEQ ID NO:86), or QQLLI (SEQ ID NO:87) at ZF3 positions +2 to +6;

(10) the amino acid sequence AKLKK (SEQ ID NO:88), AKLRK (SEQ ID NO:89), AHLRV (SEQ ID NO:90), AKLRV (SEQ ID NO:91), or SKLRL (SEQ ID NO:92) at ZF4 positions +2 to +6; the amino acid sequence ERLRV (SEQ ID NO:93), NRLKV (SEQ ID NO:94), SRLKE (SEQ ID NO:95), or NRLKV (SEQ ID NO:96) at ZF5 positions +2 to +6; the amino acid sequence RPDT (SEQ ID NO:97), RTET (SEQ ID NO:98), or RADV (SEQ ID NO:99) at ZF6 positions −1 to +3; and the amino acid sequence DNLLA (SEQ ID NO:100), SNLLV (SEQ ID NO:101), DNLMA (SEQ ID NO:102), or DNLRV (SEQ ID NO:103) at ZF7 positions +2 to +6;

(11) the amino acid sequence GHLKK (SEQ ID NO:104), AHLRK (SEQ ID NO:105), or GKLRI (SEQ ID NO:106) at ZF4 positions +2 to +6; the amino acid sequence SRLKE (SEQ ID NO:107), DALRR (SEQ ID NO:108), DGLKR (SEQ ID NO:109), or TRLRE (SEQ ID NO:110) at ZF5 positions +2 to +6; the amino acid sequence at RPDT (SEQ ID NO:111) or RTEN (SEQ ID NO:112) at ZF6 positions −1 to +3; and the amino acid sequence EHLKV (SEQ ID NO:113), DHLLA (SEQ ID NO:114), or HHLDV (SEQ ID NO:115) at ZF7 positions +2 to +6;

(12) the amino acid sequence SNLRR (SEQ ID NO:116), GNLVR (SEQ ID NO:117), GNLRR (SEQ ID NO:118), GNLKR (SEQ ID NO:119), ANLRR (SEQ ID NO:120), NNLRR (SEQ ID NO:121), or TNLRR (SEQ ID NO:122) at ZF4 positions +2 to +6; the amino acid sequence EHMKR (SEQ ID NO:123), EHMRR (SEQ ID NO:124), THMKR (SEQ ID NO:125), EHMNR (SEQ ID NO:126), or EHMAR (SEQ ID NO:127) at ZF6 positions +2 to +6; and the amino acid sequence DNLLT (SEQ ID NO:128), DNLLV (SEQ ID NO:129), DNLQT (SEQ ID NO:130), DNLLA (SEQ ID NO:131), DNLAT (SEQ ID NO:132), DNLQA (SEQ ID NO:133), DNLMA (SEQ ID NO:134), or DNLMT (SEQ ID NO:135) at ZF7 positions +2 to +6;

(13) the amino acid sequence GNLVR (SEQ ID NO:136), GNLRR (SEQ ID NO:137), GNLAR (SEQ ID NO:138), GNLMR (SEQ ID NO:139), ANLRR (SEQ ID NO:140), SNLRR (SEQ ID NO:141), or NNLRR (SEQ ID NO:142) at ZF4 positions +2 to +6; the amino acid sequence EHMNR (SEQ ID NO:143), EHMKR (SEQ ID NO:144), EHMRR (SEQ ID NO:145), SHMNR (SEQ ID NO:146), SHMRR (SEQ ID NO:147), THMKR (SEQ ID NO:148), or DHMNR (SEQ ID NO:149) at ZF6 positions +2 to +6; and the amino acid sequence EHLKV (SEQ ID NO:150), EHLAE (SEQ ID NO:151), STLNE (SEQ ID NO:152), DHLQV (SEQ ID NO:153), EHLNV (SEQ ID NO:154), DHLNT (SEQ ID NO:155), EHLQA (SEQ ID NO:156), or HHLMH (SEQ ID NO:157) at ZF7 positions +2 to +6; or

(14) the amino acid sequence GHLKK (SEQ ID NO:158), AHLKK (SEQ ID NO:159), TKLRL (SEQ ID NO:160), TKLKL (SEQ ID NO:161), GHLRK (SEQ ID NO:162), THLKK (SEQ ID NO:163), or AHLRK (SEQ ID NO:164) at ZF4 positions +2 to +6; the amino acid sequence TRLKE (SEQ ID NO:165) or SRLKE (SEQ ID NO:166) at ZF5 positions +2 to +6; and the amino acid sequence RADN (SEQ ID NO:167), RHDT (SEQ ID NO:168), RRDT (SEQ ID NO:169), RPDT (SEQ ID NO:170), RTSS (SEQ ID NO:171), or RNDT (SEQ ID NO:172) at ZF6 positions −1 to +3.

In some embodiments, the engineered CTCF variants contain two or more combinations of the above-listed amino acid sequences.

In one embodiment of the present disclosure, mutations at certain positions within the consensus CBS substantially reduced binding by the wild-type CTCF zinc finger array in a bacterial two-hybrid system that was used to select for variants from randomized libraries that are capable of recognizing the mutated CBS sequence. Combining fingers together can be used to generate variant CTCF zinc finger arrays capable of recognizing CBSs harboring multiple point mutations. In some embodiments of the present disclosure, CTCF proteins harboring these zinc finger array variants are used to restore CTCF binding activity at sites bearing one or more mutations within a CBS (i.e., non-canonical CBSs). In some embodiments of the present disclosure, CTCF variants capable of recognizing alternative non-CBS sites in the genome. In some embodiments, such CTCF variants can be used to create artificial TADs and/or enhancer-promoter loops that can purposefully insulate genes and/or perturb the higher order structure of the genome and thereby alter expression of certain target genes of interest.

Diagnosis and Treatment of Diseases

The engineered CTCF variants described herein can be used for treating diseases where aberrant gene regulation due to mutant CBS is an underlying factor. The engineered CTCF variants described herein can, for example, bind to mutant CBSs that do not bind wild-type CTCFs, thereby altering or restoring gene regulation that can reverse or slow down progression of diseases. CTCF binding has been shown to regulate expression of oncogenes, such as MYC. Mutations accumulated in CTCF binding sites and loss of wild-type CTCF binding are associated to dysregulation of oncogenes and increased risk of carcinogenesis. Transcriptional dysregulation of MYC is one of the most frequent events in aggressive tumor cells and the dysregulation is a result of mutations in CTCF binding site disrupting enhancer-promoter loop. Engineered CTCF variants can bind to the mutated sites and restore normal gene expression levels, reducing risk of cancer development. In another case, Fragile X Syndrome is the result of a duplication in a repetitive region and the loss of FMR1 expression. Duplication of a repeat region in the X chromosome disrupts a CTCF binding site, leading to the loss of an enhancer-promoter loop driving the expression of FMR1. The engineered CTCF variants could restore the enhancer-promoter loop, leading to restoration of FMR1 expression. Human Papilloma Virus (HPV) and other integrating viruses (such as HIV) are often silenced by CTCF-mediated insulation of the viral genome from nearby enhancers. In the case of HPV18, there is a CTCF binding site in the promoter region of the viral genome. HPV18 that have mutations in the CTCF binding site are not silenced because these sequence mutations in the binding site can no longer be recognized by CTCF. Engineered CTCF variants would be able to bind to the mutated HPV integrated genomes and restore the insulating loop.

Kits

Also provided herein are kits comprising the engineered CTCF variant, and/or nucleic acids encoding an engineered CTCF variant as described herein and instructions for use.

Other Applications for the Engineered CTCF Variants

The engineered CTCF variants described herein can be used in a number of other applications, some of which are disclosed herein.

In some embodiments, the engineered CTCF variant, or nucleic acids encoding such engineered CTCF variant can be used to further elucidate the complex interactions of CTCF and other chromatin organization proteins. The structural maintenance of chromosomes is tightly regulated within cells and CTCF plays a major role. It still remains unclear how higher order structures are inherited across cell division and maintained through cell differentiation, the use of CTCF variants can help clarify that role. CTCF variants might be used to investigate how loops are formed across the genome and to modify or restore normal genomic architecture in a manner that impacts endogenous gene expression for research and therapeutic applications. They might also be used to re-establish ancestral CTCF binding sites so that we may better understand the evolutionary implications of TAD-based genome organization and epigenetic regulation of gene expression or to create alternative genomic architectures that impact endogenous gene expression for research and therapeutic applications.

EXAMPLES

Materials and Methods

The following materials and methods were used in the examples set forth below.

Construction of B2H Reporter Assay Components

The zinc-finger bacterial expression plasmid contained the CTCF zinc finger array (or variants) fused to gal11P. The amino-terminal end of all or part of the CTCF 11-finger zinc finger array was fused to the carboxy-terminal end of gal11P with a Flag tag linker between them. The zinc finger expression plasmid contains a Kanamycin resistance gene. The second plasmid, known as the bacterial reporter plasmid, contained CTCF binding site sequence that was introduced via BsaI restriction digest followed by T4 mediated ligation of annealed oligos containing the CTCF binding site. The reporter plasmid contained bacterial lac promoter that promoted the expression of lacZ when the CTCF binding site was bound. The reporter plasmid also has a Chloramphenicol resistance gene.

Bacterial-Two-Hybrid (B2H) Randomized Library Construction

Complimentary oligos were synthesized by IDT with 'VNS' or 'NNS' variation introduced in the sequence by design. Oligos were annealed and ligated into the zinc finger expression plasmid (previously digested with XbaI and BamHI) using T4 ligase. Ligation reaction was purified using Qiagen Minelute column and the purified substrate was electro-transformed into electro-competent XL1blue $E.$ $coli$ strain. After 1 hour recover in SOC at 37° C., the transformation was inoculated into 150 mL Luria broth (LB) with 50 ug/mL of Kanamycin. After the culture reached a OD600 of 0.400-0.600 (about 10 hours growth at 37° C.) the culture was spun down and the library was harvested using Qiagen Maxiprep kit.

Bacterial-Two-Hybrid (B2H) Reporter Assay 600 ng of gal11P-zinc finger expression plasmid and 600 ng of reporter plasmid with CTCF binding site of interest were chemically transformed into 150 uL of Δλ $E.$ $coli$ strain with an alpha N-terminal domain of RNA polymerase (α-NTD)-Gal4 fusion. Plasmid and cell mixture was incubated on ice for 30 minutes, heat shocked at 42° C. for 1 minute, recovered on ice for 2 minutes, followed by recovery in 500 uL of Luria Broth for 1 hour. Post-recovery, transformation was plated on Kanamycin (50 ug/mL), Chloramphenicol (12.5 ug/uL) selective LB agar plates. After 14-16 hours of growth at 37° C., colonies were picked and grown overnight in 1 mL of induction media (Luria broth with 50 ug/uL of Kanamycin, 12.5 ug/mL of Chloramphenicol, 10 ug/mL of ZnCl, and 500 ug/mL of IPTG). After 15-17 hours of growth, 25 uL of the overnight culture was sub-cultured into 1 mL of fresh induction media and grown for 2 hours at 37° C. or until cultures were between OD595 0.157-0.268 as measured by spectrophotometer. 100 uL of the subculture in then lysed for minimum of 15 minutes using 11 ul of a 1:10 mixture of lysozyme and PopCulture soap. 15 uL of the lysis mixture was then analyzed for fold activation of LacZ by previously described colorimetric ONPG assay. Binding was quantified by fold activation of LacZ. Fold activation was determined by calculating the fold increase of β-gal levels of a sample above the β-gal levels of the negative control (no zinc finger protein fused to gal11P).

Bacterial-Two-Hybrid (B2H) Selection Assay

Plasmids involved in the selection assay are the same as before with only one difference: The reporter plasmid is made to be a selective plasmid by swapping LacZ with BlaC, an antibiotic resistance gene for β-lactam ring class of antibiotics, such as Carbenicillin. Selections are carried out by constructing libraries of variants from a pool of oligos ligated into the zinc finger-gal11P expression plasmid. These are electro-transformed into electro-competent *E. coli* strain containing the selective plasmid with the CTCF binding site of interest. Cells are recovered in 1 mL of SOC for 1 hour at 37° C. followed by induction of selective plasmid for 3 additional hours at 37° C. in 4 mLs of induction media (previously described). After four total hours, transformations are plated on low stringency plates (LB agar with 50 ug/mL of Kanamycin, 12.5 ug/mL of chloramphenicol, 100 ug/mL of Carbenicillin, 10 ug/mL of zinc chloride, and 200 ug/mL, IPTG and 0.45 ug/mL of Clavulanic acid). Plates are grown overnight at 37° C. for 20-24 hours and then colonies are harvested off the surface with 2 mL of LB. 50 uL of the scrapped colonies are sub-cultured into 1 mL of terrific broth (TB) with 50 ug/mL of Kanamycin, and 12.5 ug/mL of Chloramphenicol and grown 14-16 hours at 37° C. The next day, plasmid is harvested from the overnight cultures and chemically transformed into chemically competent Δλ *E. coli* strain containing the same selective plasmid with the CTCF binding site of interest as before. The chemical transformation is performed as previously described with the addition of 2 hour growth in induction media following a 1 hour recovery at 37° C. After a total of 3 hours of growth, cells are plated on high stringency selective gradient plates. The high stringency gradient plates contains 50 ug/mL of Kanamycin, 12.5 ug/mL of Chloramphenicol, 100 ug/mL of Carbenicillin, 10 ug/mL of ZnCl, 200 ug/mL of IPTG with a gradient of Clavulanic acid starting from ~1 up to 40 ug/mL in concentration. Plates were incubated 20-24 hours at 37° C. Colonies that grew on the gradient with the highest levels of Clavulanic acid were picked and grown in 1mL of TB with 50 ug/mL of Kanamycin and grown overnight in order to harvest the plasmid. The variant plasmid was then Sanger sequenced as well as analyzed for binding activity in the B2H β-gal reporter assay.

High Stringency Gradient Plates

The high stringency gradient plates contains 50 ug/mL of Kanamycin, 12.5 ug/mL of Chloramphenicol, 100 ug/mL of Carbenicillin, 10 ug/mL of ZnCl, 200 ug/mL of IPTG with a gradient of Clavulanic acid starting from ~1 to 40 ug/mL in concentration. To obtain a gradient of Clavulanic acid, rectangle plates are elevated using a pipette tip so as to have a ~25° C. slope (enough of an angle so that the thin end of the wedge is only barely covered with LB agar). 20-25 mL of LB agar with 50 ug/mL of Kanamycin, 12.5 ug/mL of Chloramphenicol, 100 ug/mL of Carbenicillin, 10 ug/mL of ZnCl, 200 ug/mL of IPTG and 4 ug/mL of Clavulanic acid is added to the inclined plate to form the bottom wedge. Once solidified, the plates are laid flat and 20-25 mLs of LB agar with 50 ug/mL of Kanamycin, 12.5 ug/mL of Chloramphenicol, 100 ug/mL of Carbenicillin, 10 ug/mL of ZnCl, 200 ug/mL of IPTG (with no Clavulanic acid) is poured on top. This creates plates with a gradient of Clavulanic acid ranging from ~1 ug/mL up to 4.0 ug/mL.

CTCF Binding Assay Using ChIP-qPCR

K562 cells were seeded 18-24 hours in advance of transfection at a density of $3 \times 10^5$ cells/mL. 3 million K562s per variant were transfected using Lonza Kit V using the provided optimized protocol and pooled in a 10 cm dish. 5 ug of plasmid expressing HA epitope tagged CTCF (wild-type or variant) expressed by a pCAG promoter was used for each 1 million cell reaction. 72 hours post transfection, approximately 10 million cells were crosslinked with 1% Formaldehyde at 37° C. for 10 mins. Reaction was quenched with 1.2 mL of 2.5M Glycine for 5 mins at 37° C. Cells were pelleted at 430 g for 10 mins and sonicated on SFX250 Branson sonifier for 5.5 mins, 32% Amplitude, 1.3s off, 0.7s on. The samples were then split in half, one precipitated overnight, rotating at 4° C. with antibody specific to CTCF and the other precipitated overnight with HA specific antibody. The next day, antibody bound chromatin complexes were incubated with G-dynabeads for 2 hours at 4° C., rotating. Beads were washed three times in 1 mL of ice-cold RIPA 150 Wash Buffer (0.1% SDS, 0.1% DOC, 1% Triton X-100, 1 mM EDTA, 10 mM Tris-HCl pH 8, 150 mM NaCl), three time in 1 mL of ice-cold RIPA 500 wash buffer (0.1% SDS, 0.1% DOC, 1% Triton X-100, 1 mM EDTA, 10 mM Tris-HCl pH 8, 500 mM NaCl), three times in 1 mL of ice-cold LiCl wash buffer (10 mM Tris-HCl pH8, 250 mM LiCl, 0.5% Triton X-100, 0.5% DOC), and once in 1 mL of ice-cold 10 mM Tris-HCl pH 8.5. The antibody chromatin complex was eluted from the beads in 100 uL of Elution Buffer (10 mM Tris-HCl pH 8, 0.1% SDS, 150 mM NaCl) with 5 mM DTT added fresh. Beads were incubated with elution buffer at 65° C. for 1 hour, shaking at 900 rpm. Beads were pelleted by magnet and supernatant was moved to a clean tube where, after cooling to room temp, 1 uL of RNAse (Roche 11119915001) was added to the sample and incubated at 37° C. for 30 mins at 600 rpm. 3 uL of Proteinase K [20 mg/mL] was added to samples and incubated overnight at 65° C. (Lifetech #100005393). The next day, 100 uL of SPRI beads with 160 uL of PEG/NaCl (20% PEG, 2.5M NaCl) were added to samples, vortexed and incubated at room temp for 5 minutes before pelleting beads on a magnet. Pellet was washed twice with 80% ethanol and air dried for 5 minutes before final elution in 150 uL of 10 mM Tris-HCl pH 8. 3 uL of recovered supernatant was mixed with 5 uL of SYBR qPCR master mix and 2 uL of primer mix for quantification of fragment enrichment over 1% input untreated by antibody by Real Time-qPCR.

Generation of Variant Binding Site Cell Lines

Cell lines with the variant binding site introduced at the CTCF binding site ~2 kb upstream of MYC TSS were generated by nucleofecting exoMYC.K562 with SpCas9-P2A-GFP, gRNA targeting the CTCF binding site, and one of 6 distinct ssODNs as HDR templates to introduce the 6 different variant binding sites. exoMYC.K562 is K562 cell line transduced with exogenous MYC construct expressed off of PGK promoter. This was necessary as any reduction of endogenous MYC expression can impact the survival of K562 cells. GFP+ cells were sorted at a high dilution into a 96 well plate for single-cell clonal expansion. Once expanded, gDNA and RNA was extracted to genotype and phenotype the clonal cell population. Clonal lines that had a reduction of endogenous MYC and also appeared homozygous at the target site for the desired HDR event were used in the study.

Quantifying MYC Expression by RT-qPCR

Three million K562 cells genome edited to harbor the variant binding site upstream of MYC were nucleofected with 5 ug of plasmid expressing a variant CTCF following the Lonza Kit V protocol. 72 hours post nucleofection, 1 million cells were isolated for RNA extraction following the NucleoSpin RNA Plus RNA isolation protocol. The RNA was converted to cDNA via Thermo High-Capacity RNA-to-cDNA Kit. 3 uL of 1:20 dilution of cDNA was mixed with 5 uL of Thermo Fast SYBRgreen Master Mix and run on RT-qPCR machine following standard PCR amplification protocol.

Results

Single Nucleotide Substitution at CBS Affecting CTCF Binding Efficiency

Figure 2:
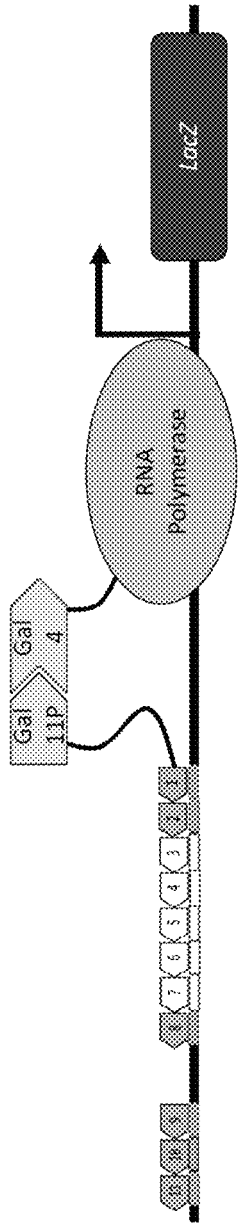
FIG. 2: Diagram of B2H Beta-galactosidase reporter assay. The B2H reporter assay used Gal11P-mediated recruitment of Gal4 to indicate binding. E. coli is transformed with two plasmids: one plasmid encoded for both a zinc finger-Gal11P fusion and an alpha N-terminal domain of RNA polymerase (α-NTD)-Gal4 fusion; the second plasmid contained a modifiable binding sequence upstream of a weak promoter that drives the expression of the lacZ gene, which encodes for β-galactosidase. A zinc finger-Gal11P fusion that was able to bind to the target sequence recruited the α-NTD-Gal4 fusion to the promoter, thereby inducing the expression of lacZ. This increase in β-galactosidase levels was detected by a simple colorimetric ONPG-based assay. The CTCF zinc finger array-gal11P fusion was bound to a CTCF binding site in this diagram, recruiting the α-NTD-Gal4 fusion to the promoter region upstream of lacZ, leading to expression.

We reasoned we could use a bacterial two-hybrid (B2H) system to evolve the zinc finger array of CTCF to bind to mutated CBSs bearing single or multiple sequence changes that disrupt wild-type CTCF binding (Wright et al. Nature Protocols (2006); Sander et al., Nature Methods (2010); Maeder et al. Molecular Cell. (2008)). We used a previously described bacterial-two-hybrid (B2H) system to systematically define the impact of single nucleotide substitutions within a previously defined consensus CBS site (Joung et al., PNAS (2000)). In the B2H system, the binding of a DNA-binding zinc finger array to a target site of interest can be configured to result in increased transcription of a reporter gene (e.g., beta-galactosidase or an antibiotic resistance gene) (FIG. 2). To do this, two fusions are expressed in an E. coli cell bearing a reporter construct. The first fusion consists of a zinc finger array fused to a fragment of the yeast Gal11P protein, which interacts with a fragment of the yeast Gal4 fusion. The second fusion consists of a fusion of the N-terminal domain of the E. coli RNA polymerase alpha subunit to the yeast Gal4 fragment (the α-Gal4 fusion). The reporter construct consists of a weak E. coli promoter that drives expression of the reporter gene of interest with a binding site for the zinc finger array positioned upstream of the promoter. Binding of the zinc finger-Gal11P fusion to the zinc finger binding site results in recruitment of RNA polymerase complexes harboring the alpha-Gal4 fusion, resulting in increased transcription of the reporter gene. If the reporter gene is lacZ, which encodes for β-galactosidase (β-gal), the level of beta-gal expression can be easily quantified using a well-established colorimetric ONPG-based assay (FIG. 2).

Figure 3:
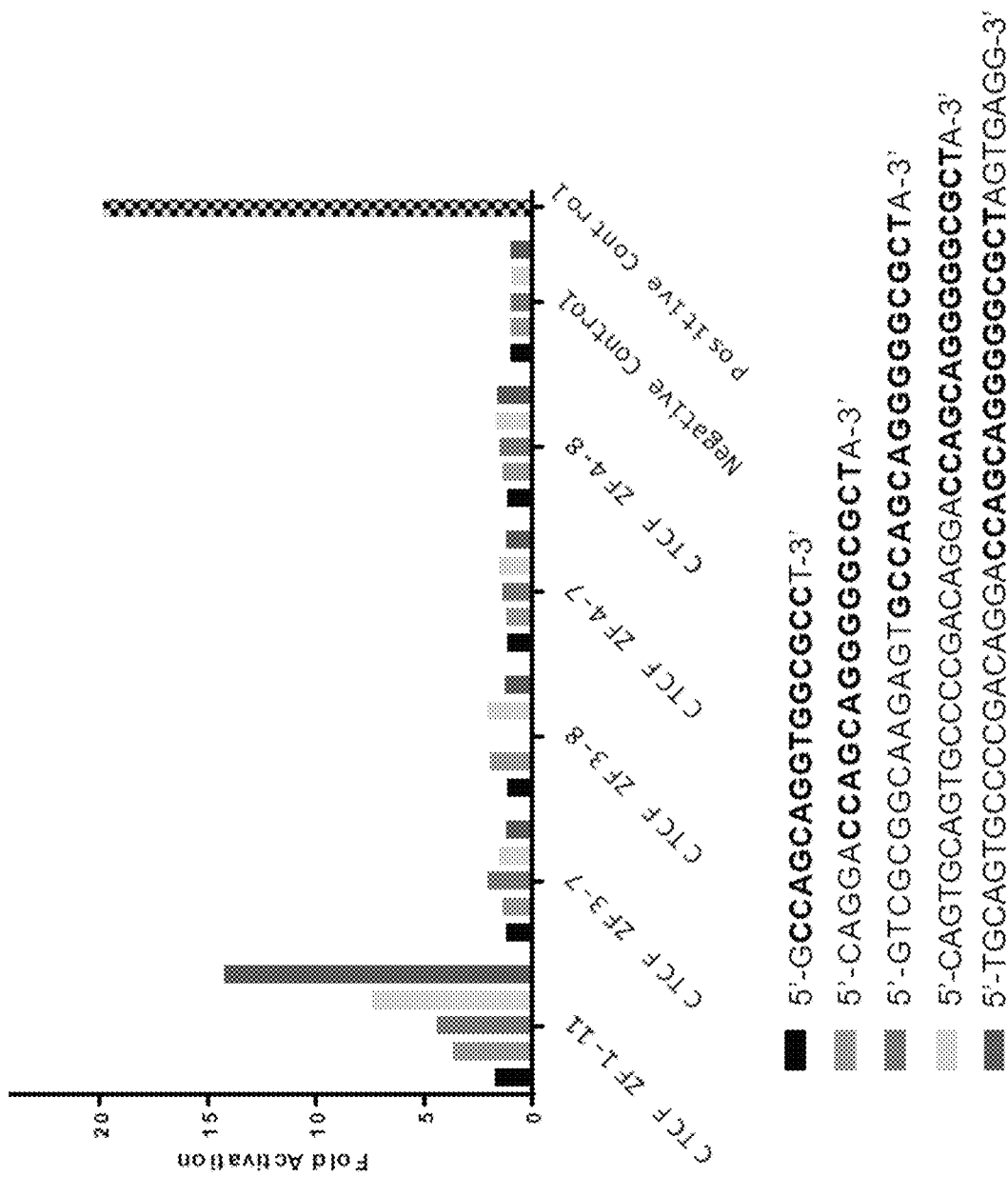
FIG. 3: Fold activation in the B2H B-gal assay was greatest when CTCF zinc fingers 1-11 of 11 finger array interacts with full length target site. Five target sites (sequence indicated in the legend) were tested along with the full CTCF zinc finger array and four different subsets (indicated on the x-axis). The core sequence (black and bolded) which is the most highly conserved sequence of CTCF binding sites was tested independently and with different quantities of flanking sequence as derived from Hashimoto, H. et al. Mol. Cell. 2017 (black and light gray); Persikov, A and Singh, M. NAR. 2014 (medium gray); and Nakahashi, H. et al., Cell Rep. 2013 (very light gray and dark gray). Positive control reflects binding activity of a known 3-finger zinc finger that binds strongly in bacterial and human contexts to a known sequence. The negative control reflects baseline beta-galactosidase levels when the alpha N-terminal domain of RNA polymerase (α-NTD)-Gal4 fusion is not directly recruited to the promoter of lacZ. This baseline was used to calculate fold activation when the CTCF zinc finger array is fused to gal11P.
Figure 4:
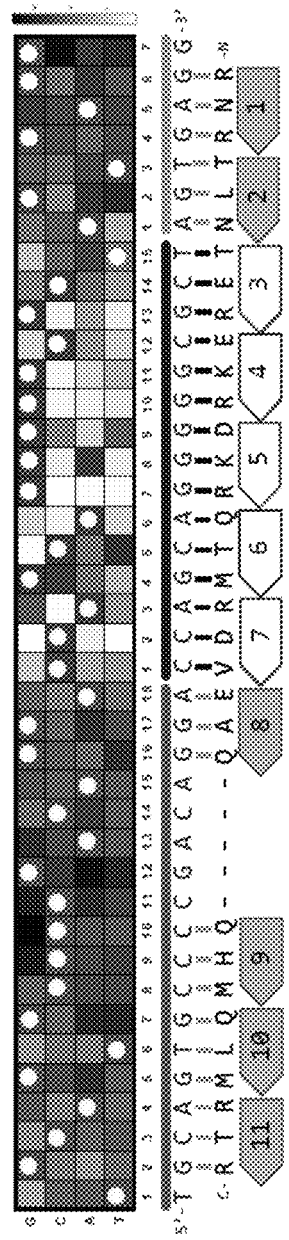
FIG. 4: CTCF zinc finger array is sensitive to sequence changes at certain positions of the core region within the CTCF binding site. Each of the four possible nucleotides at each position of the 40 bp reference CBS were tested for ability to bind the CTCF zinc finger array in the B2H y. Fold activation reflects binding activity above background β-galactosidase levels (Background β-gal levels are obtained from the levels of β-gal from samples with each binding site in the presence of the gal4-RNA polymerase fusion with no zinc finger array fused to gal11P). The reference sequence above is partitioned into three segments: 5' flanking (dark gray lined), core (black lined), and 3' flanking (gray lined). The position of each nucleotide within each segment are numbered. Dashes indicate known DNA-protein contacts (black) and theoretical DNA-protein contacts (gray) between the zinc finger array and the binding site. Core sequence 1-15 of the binding site (black, bold) interacts with zinc finger 3-7 of the array (white, black outline) and appear to be most sensitive to changes in the binding sequence. Alterations to the 5' flanking sequence as well as the 3' flanking sequence did not negatively impact binding.

In this B2H reporter assay, we determined the entire zinc finger array (ZF1-11) and the full CTCF binding site (CBS), not just the 15 bp consensus CBS sequence, was required for optimal expression of the lacZ gene (FIG. 3), which mimics observed CTCF binding requirements in human cells 10, 11. After optimizing positioning of the CBS site relative to the transcription start site, we then systematically introduce point mutations into the CBS and tested their impact on lacZ expression. These results demonstrated that mutation of nucleotides outside the 15 bp core sequence had little impact on lacZ expression. By contrast, binding, however certain sequences at certain positions within the core sequence resulted in no or reduced binding (FIG. 4). Our results closely match ChIP-Seq data for CTCF binding sites in human cells and reflect other studies in the literature in which point mutations in the CTCF core lead to loss of CTCF binding. Taken together, these results strongly suggest that binding activity of the CTCF zinc finger array in the B2H system mimics the binding activity of intact CTCF protein in human cells.

Figure 5:
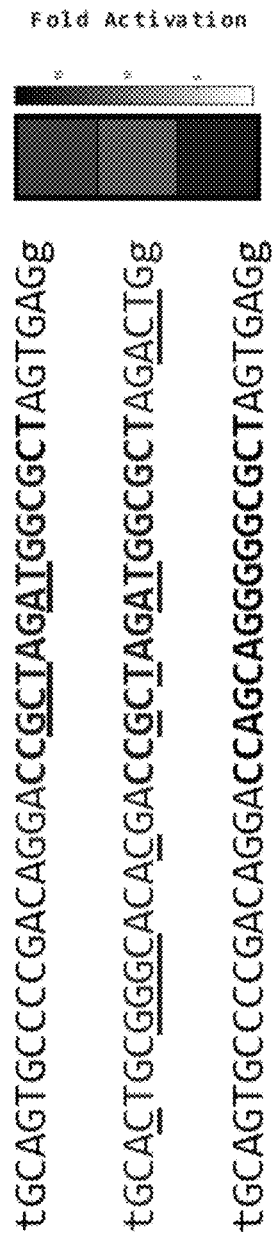
FIG. 5: Maximizing binding potential of the CTCF binding site. Modifications were made to the reference binding site (bottom) to combine nucleotide changes that, individually, showed increased binding activity of the CTCF zinc finger array. The core sequence motif is bold while changes made are underlined. Binding activity of the 11-finger CTCF zinc finger array was quantified in the B2H Beta-galactosidase reporter assay in triplicate. Fold activation reflects binding activity above background levels when no DNA binding protein is present.

Although most sequence changes in the flanking regions of the binding site had little impact on binding efficiency, certain alterations appeared to slightly improve the fold-activation of lacZ expression. Therefore, we tested whether a more "optimized" CBS bearing the "best" nucleotides as defined in the B2H assay might lead to higher-fold activation of lacZ expression but we did not observe any higher activity compared with the original consensus sequence (derived from Nakahashi et al. ChIP-seq data) (FIG. 5).

Figure 6:
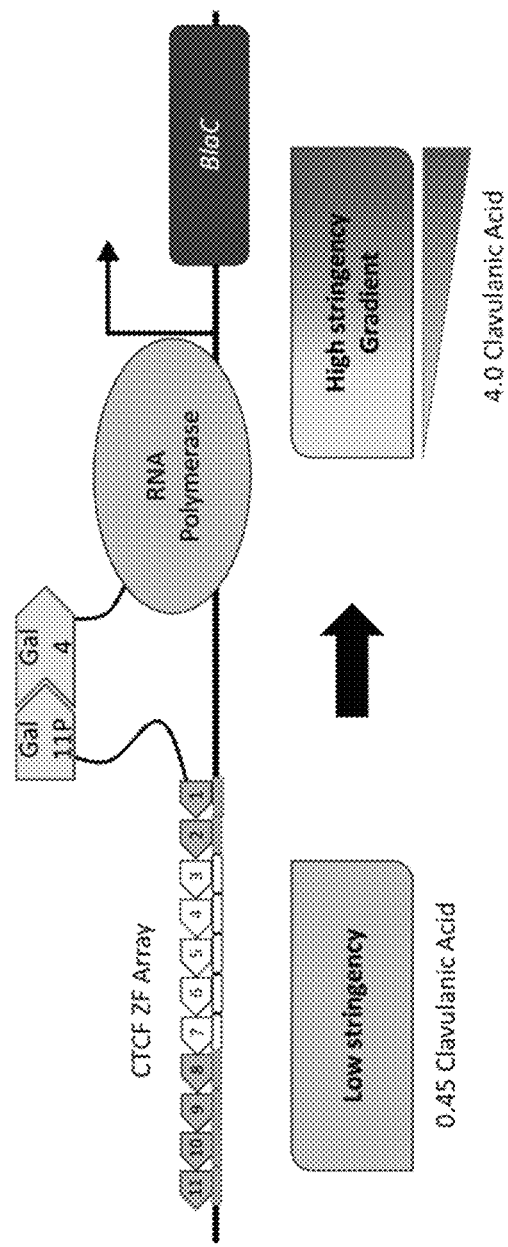
FIG. 6: Diagram of B2H Beta-lactamase inhibitor selection. The selection system contained the same components as the reporter system except successful binding of the zinc finger array to the CBS drove BlaC expression, an inhibitor of the beta-lactamase class of antibiotics, instead of lacZ. Expression of BlaC allowed for growth on Carbenicillin plates. The selection was driven by the addition of Clavulanic acid, an inhibitor of beta lactamase inhibitors. Low level expression of BlaC can result in growth on Carbenicillin plates, but the addition of clavulanic acid inhibits BlaC activity and results in the depletion of false positives and further enrichment of strong binders to any modification made to the binding site. Libraries of mutations in the zinc finger array fused to gal11P were selected for binders to an altered binding sequence through low stringency conditions followed by selection on a gradient of clavulanic acid. Growth on the highest stringency end of the gradient indicated variants in the zinc finger array that are strong binders to the new binding sequence.
Figure 9A:
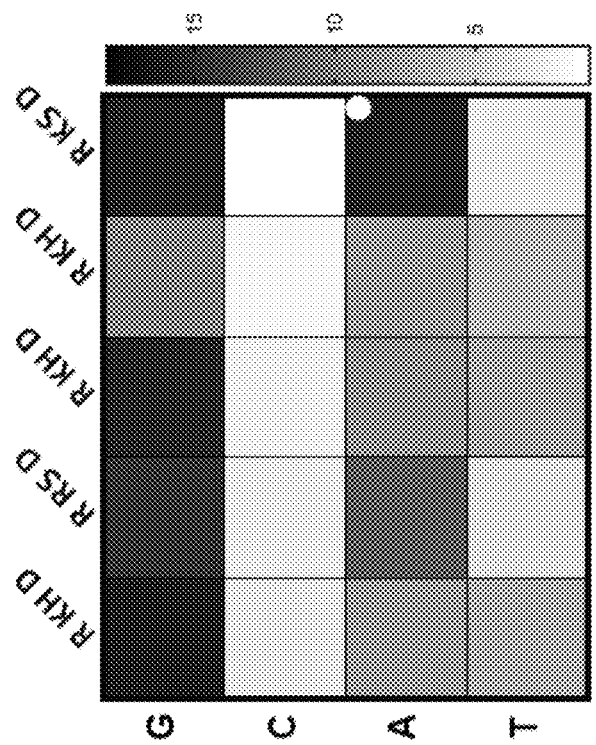
FIGS. 9A-C: Selected variants binding altered binding sites sequence at position 3 of core motif in CBS. Selections performed on library of variants centered around alterations in position −1 to 3 of recognition helix in ZF7 of the 11 finger CTCF zinc finger array. 'VNS' codons were introduced at positions indicated by 'X' and selected against three different nucleotide changes at position 3 of the core motif in the CBS (gray star). Direct protein-DNA contacts are indicated by dashed lines. (A) Selections performed on A:T change in the binding site, (B) A:G change, (C) A:C change. Most variants pulled out had relaxed binding specificity instead of altered specificity.
Figure 9A:
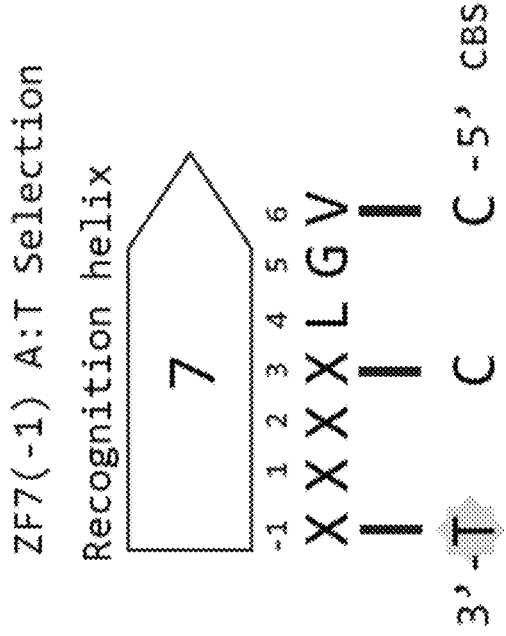
Figure 9B:
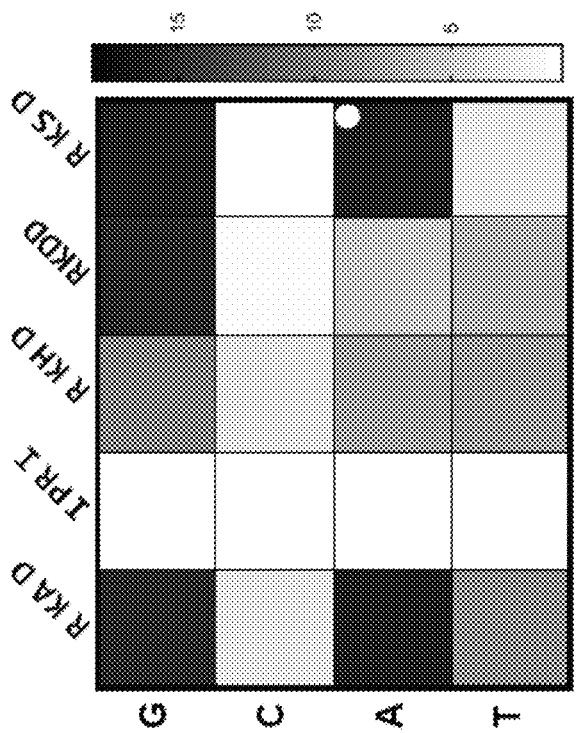
Figure 9C:
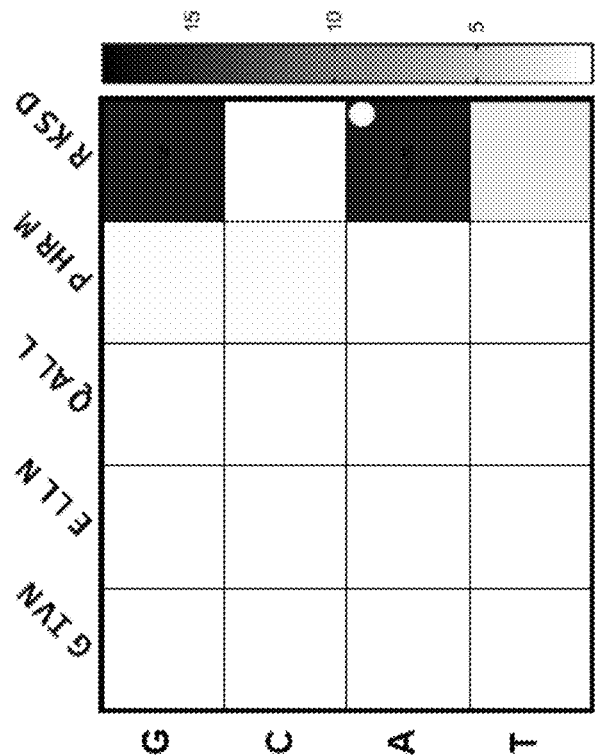
Figure 9C:
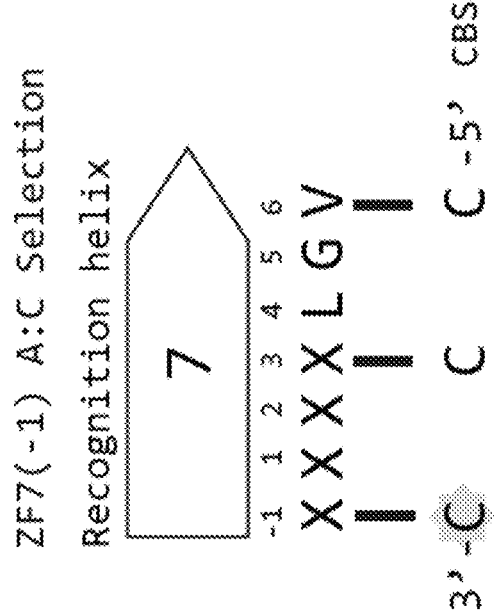
Figure 10B:
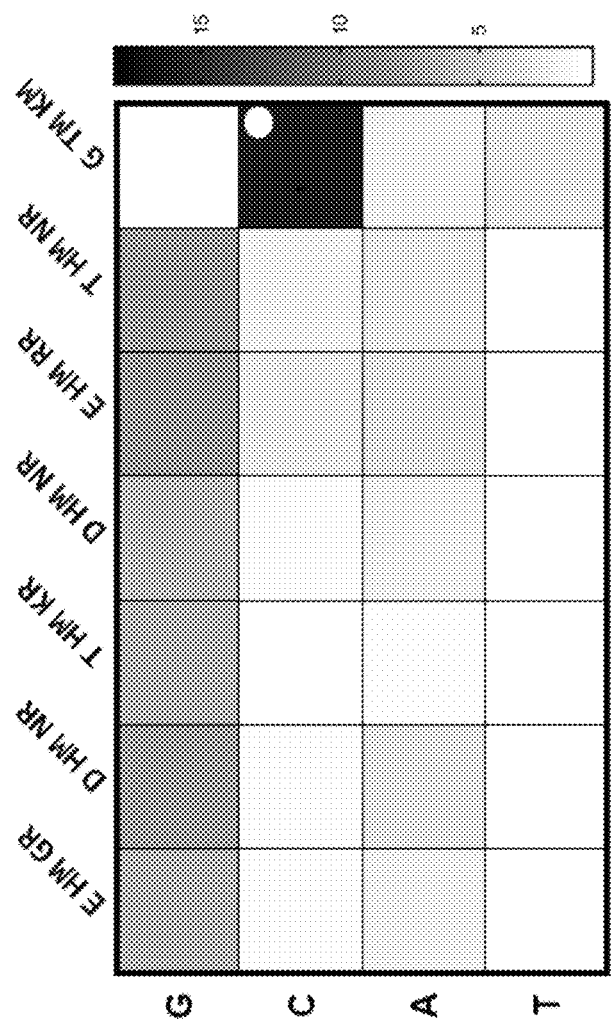
Figure 10B:
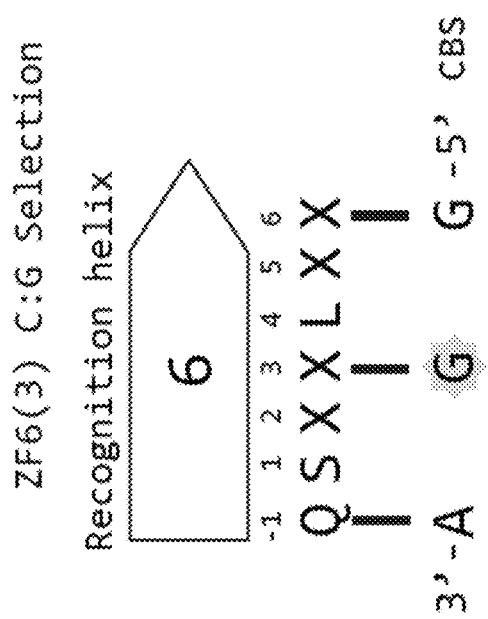
Figure 11A:
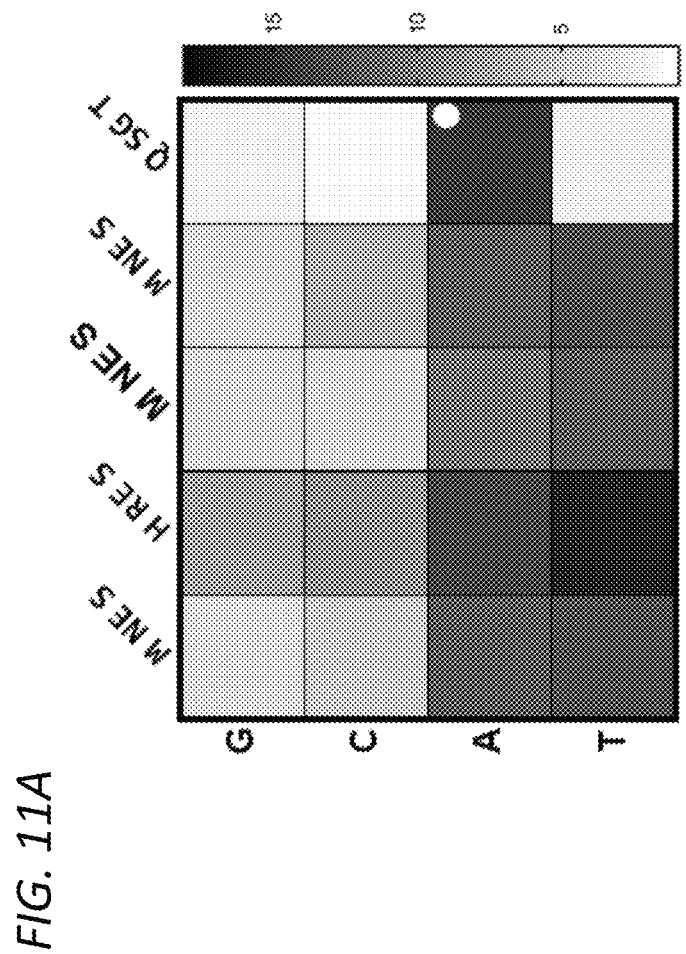
Figure 11A:
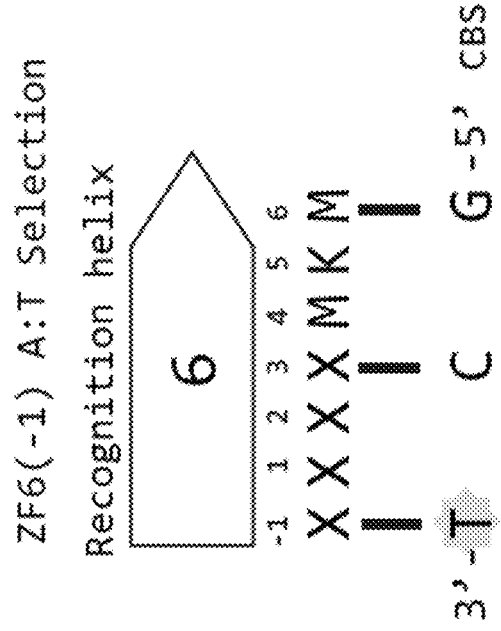
Figure 11C:
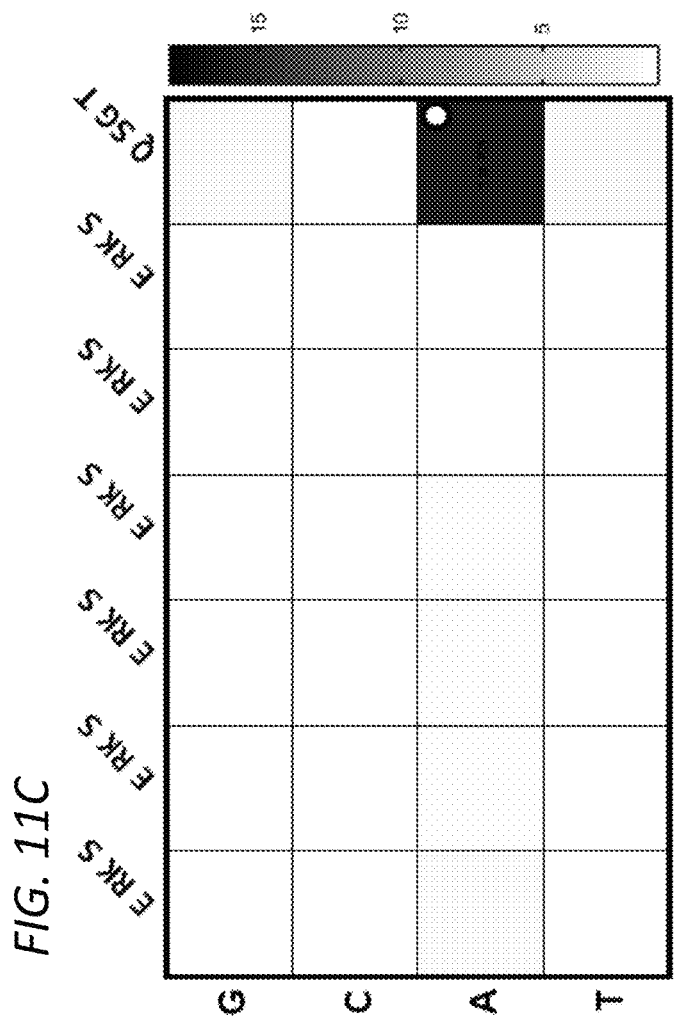
Figure 11C:
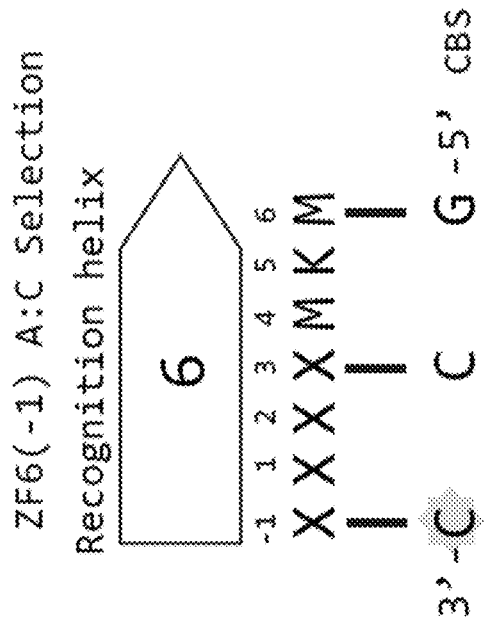
Figure 12B:
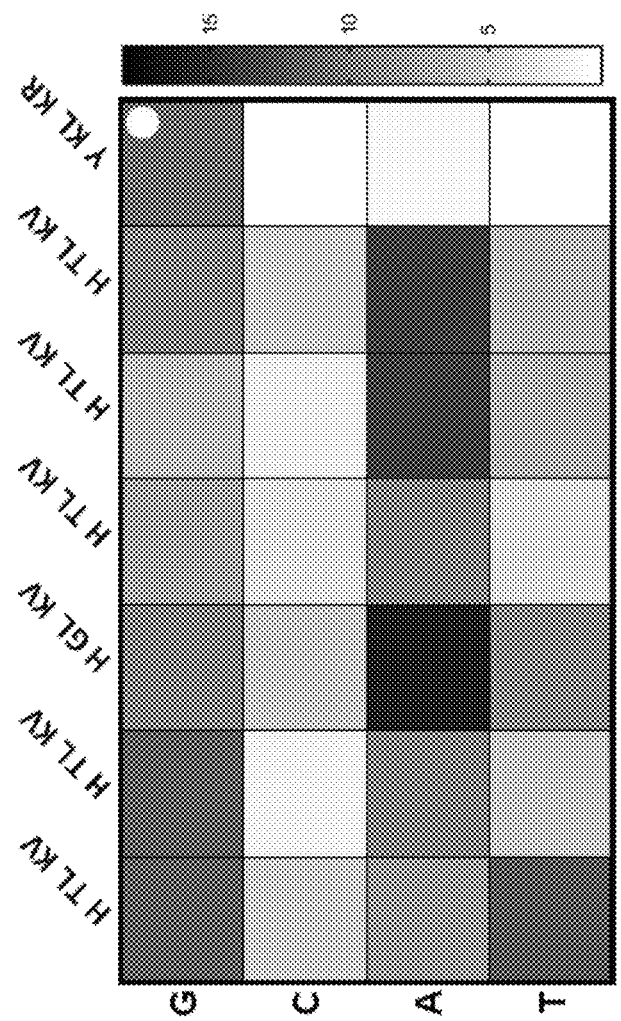
Figure 12B:
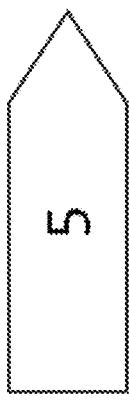
Figure 12C:
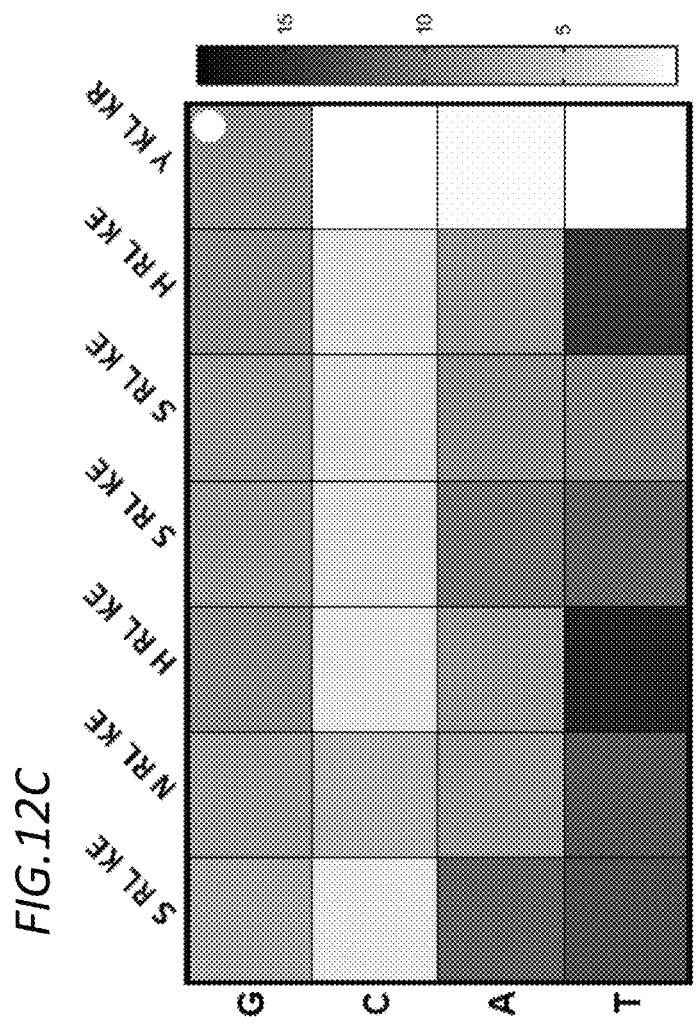
Figure 12C:
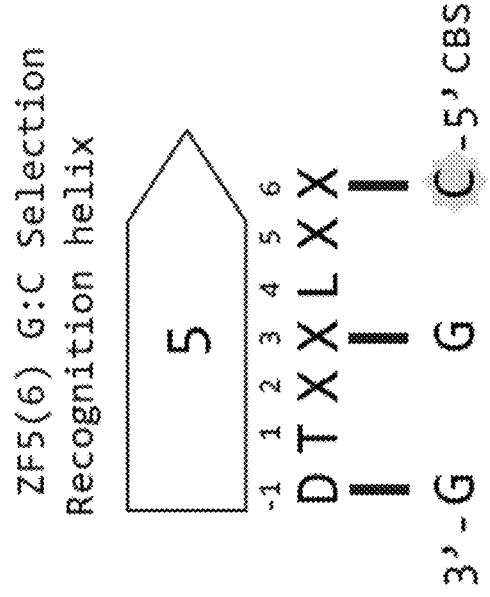
Figure 13A:
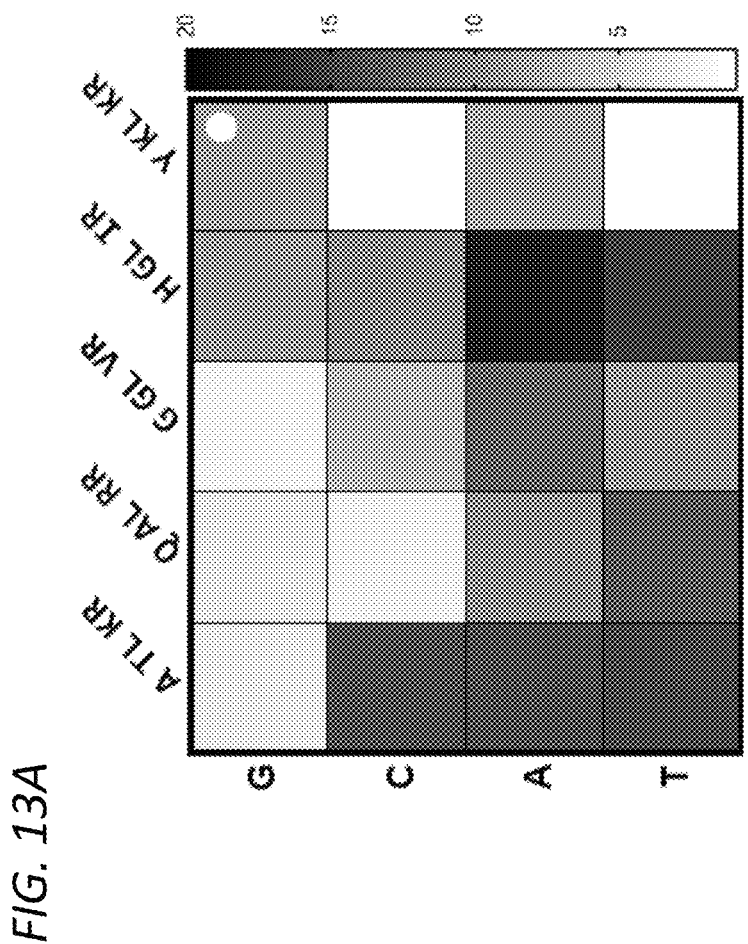
Figure 13A:
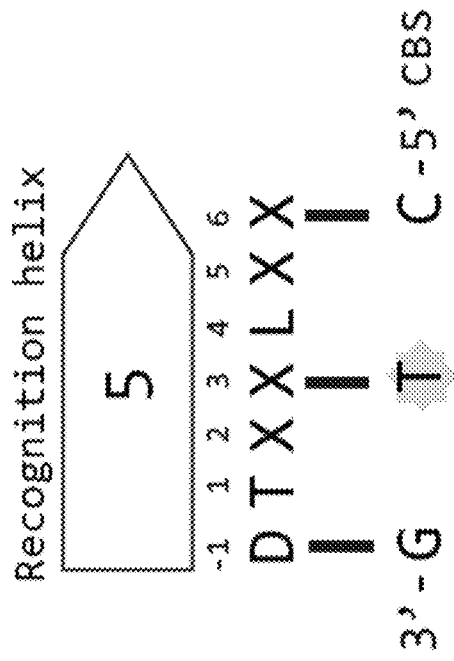
Figure 13B:
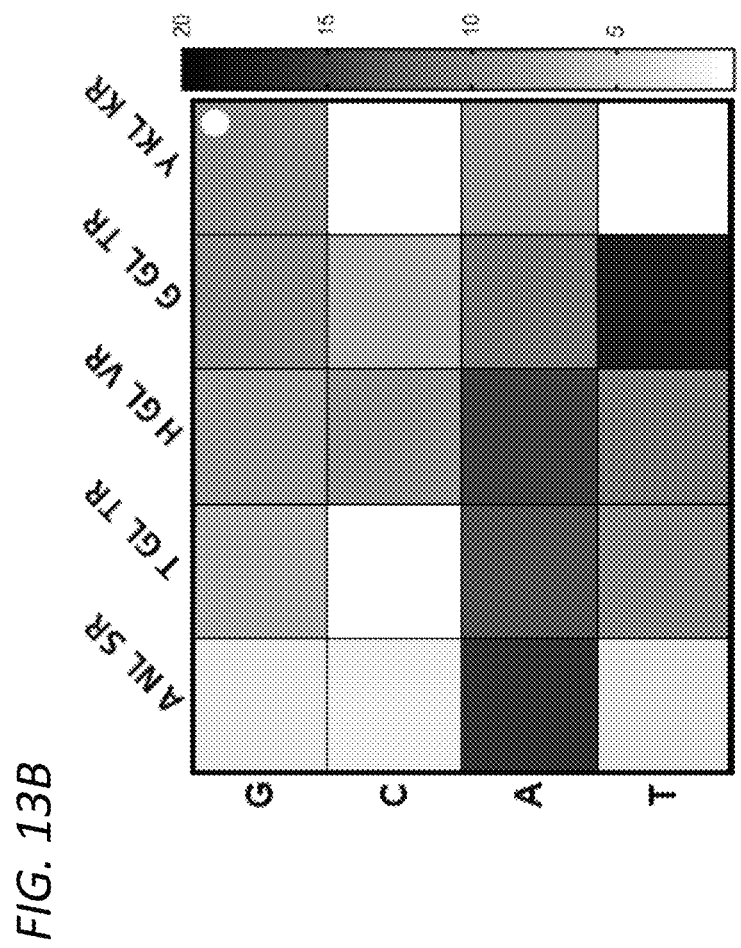
Figure 13B:
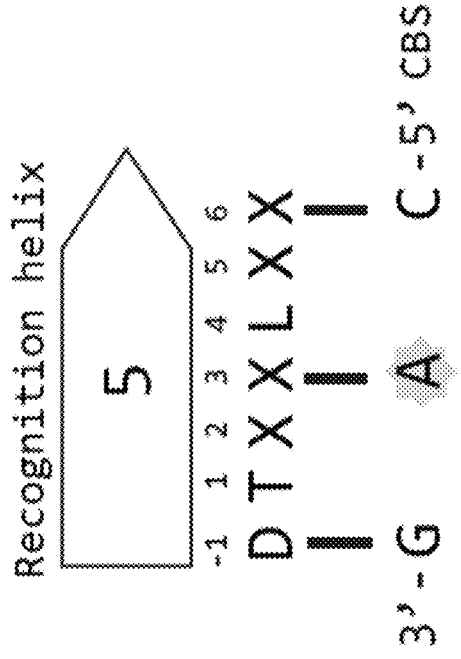

Generation of Engineered CTCF Variants That Bind to Mutated CBSs with Single Altered Nucleotide Next, we sought to determine if we could use the B2H system to select for CTCF zinc finger array variants capable of recognizing mutated CBSs not recognized by the wild-type CTCF zinc finger array. To do this, we modified the B2H reporter construct, replacing the lacZ gene with the blaC gene (FIG. 6), which encodes beta-lactamase and therefore confers resistance to beta-lactam antibiotics (e.g., carbenicillin). This modification enables us to select for cells that express a CTCF zinc finger array variant that can efficiently bind a mutant CBS positioned upstream of the weak promoter driving blaC expression. Increasingly higher levels of blaC expression can be selected for by using media containing carbenicillin and increasingly higher concentrations of the beta-lactamase inhibitor clavulanic acid. Gradients of clavulanic acid can be created within a single agar plate (FIG. 6; see Materials and Methods), thereby enabling sampling of cells at various concentrations of the inhibitor.

With this modified B2H selection system, we first sought to identify CTCF zinc finger array variants that can bind to CBSs bearing single point mutations that abolish binding by the wild-type CTCF zinc finger array in this system. In an initial set of selection experiments, we sought to identify CTCF zinc finger array variants that could bind to mutant CBSs bearing mutations of the C that is contacted by an aspartic acid (D) present at the third position (+3) of the alpha-helical recognition helix of ZF7 (shown by previously published co-crystal structures cited above). We created a randomized library of CTCF zinc finger array variants in which the codon encoding the ZF7 +3 position was randomized using a degenerate NNS codon (where N=G, A, C, or T and S=G or C). We then used the B2H selection system to interrogate this library to identify variants capable of recognizing CBSs bearing C to T, C to G, and C to A substitutions at the position contacted by ZF +3. Selections were initially performed on low stringency plates with clavulanic acid gradients ranging from 0 to 0.45 ug/ml) and surviving colonies harvested and plasmids encoding the variant zinc finger arrays were purified. This selected subset of variants was then subjected to high stringency selection in the B2H system on plates with carbenicillin and gradients of clavulanic acid ranging from 0 to 4 ug/ml). Plasmids encoding variant zinc finger arrays were purified from colonies that grew on the end of the gradient plate with highest concentration of clavulanic acid, sequenced, and then tested in the B2H reporter assay by beta-galactosidase assay.

As can be seen in FIGS. 7A-C, we obtained CTCF zinc finger array variants that showed preferential binding activity (as judged by the B2H reporter assay) for the mutated CBS compared with the original consensus CBS. These clones also showed selection for a particular amino acid at the ZF7 +3 position: for the C to T site, a threonine (T) was selected, for the C to A site, an asparagine (N) was selected, and for the C to G site a histidine (H) was selected. The identities of these amino acids is consistent with what might be expected to recognize the mutant nucleotide based on previous zinc finger selections using the Zif268 zinc finger array. However, although we successfully selected for mutants that had altered binding activity, in most cases, the binding activity of the variant for the mutated CBS was not as strong (as judged by the B2H reporter assay) as that of the wild-type CTCF zinc finger array for the consensus CBS (FIGS. 7A-C).

Based on our previous experience with re-engineering the DNA-binding specificities of the Zif268 zinc finger array, we hypothesized that obtaining stronger binding variants might require alteration of amino acids flanking the +3 position in ZF7. To test this idea, we created a larger library of variants in which we randomized positions +2, +3, +5 and +6 of ZF7 using degenerate VNS codons (where V=G, A, or C). Position +4 of ZF7 was not altered because it faces the internal core of the ZF domain and is not expected to make contacts to the DNA. We then performed B2H selections as described above using this library to identify variants that could identify a mutant CBS with a C to G mutation at the position contacted by ZF7 +3 in the wild-type CTCF zinc finger array. These selections identified variants that showed stronger binding activity for the mutant CBS and showed some degree of consensus in the identities of amino acids selected (FIG. 8).

Based on this success, we generated additional randomized libraries in which randomized positions −1, +1, +2, and +3 or +2, +3, +5 and +6 for ZF7, ZF6, ZF5, ZF4, and ZF3. We then performed selections as described above using these libraries against various matched mutant CBSs harboring nucleotide substitutions at positions expected to be contacted by residues randomized in the libraries (FIGS. 9-16). Analysis of variants from individual surviving colonies at the most selective end of the high stringency selection plates showed that many of these selections yielded variants with high activity for the mutant CBS of interest and sequencing of these clones showed that there was generally a degree of consensus in the amino acid sequences suggesting that selection was successfully occurring (FIGS. 9-16).

Generation of Engineered CTCF Variants That Bind to Mutated CBSs with Multiple Altered Nucleotides Having successfully identified CTCF zinc finger variants that could recognize CBSs with a single altered nucleotide position, we next sought to identify variants that could recognize CBSs bearing multiple mutated nucleotides. To do this, we sought to recombine ZF variants each selected to bind to different "subsites" within the CBS that bear individual mutations. However, because of well-known context-dependent effects that exist between ZFs in a multi-finger array, we undertook a strategy in which we recombined together pools of selected ZF variants (rather than a single variant) for any given altered subsite to identify the combinations of mutated ZFs that best work together to recognize a CBS bearing multiple mutations. To isolate pools of ZF variants for various mutated CBS subsites, we harvested all remaining clones from the high stringency selection plates we performed with the CBS sites bearing single mutations (depicted in FIGS. 9-16). Deep sequencing of the various selected clones in these pools yielded a variety of sequences with some degree of consensus within each selection as expected (Table 1).

We then recombined pools of variants for ZFs 4, 5, 6, and 7 to create CTCF zinc finger arrays that harbored various altered recognition helices for these positions and then performed B2H selections (see Materials and Methods) against five different mutated CBSs bearing combinations of various nucleotide substitutions in subsites for ZFs 4, 5, 6, and 7 (FIGS. 17-21). Sequencing of clones from these selections showed that certain recognition helix sequences for each finger were selected multiple times, suggesting that the selections were identifying combinations that work well together. Importantly, for all five of the multiply mutated CBSs, several of the CTCF zinc finger array variants identified showed good binding activity on the site for which they were selected as judged by B2H assay (FIGS. 17-21). In addition, for four of the five mutant CBS sites, we were able to identify variants that not only bind to the mutant CBS but also fail to bind to the original unmutated (consensus) CBS. Thus, we conclude that using our approach described here we are able to identify CTCF ZF array variants capable of recognizing multiply mutated CBSs that are not efficient bound by the original wild-type CTCF zinc finger array.

Binding Specificity of Engineered CTCF Variants to Mutant and Wild-Type CBSs in Human Cells Having successfully engineered variants that can recognize CBSs with multiple sequence changes across the motif, we next wanted to investigate whether the variants can bind to these same mutant binding sites in a human cell context while not binding to wild-type CBSs. First, we found a collection of sites in the human genome that matched the 15 bp core sequence for each of the five mutated binding sites that we had selected CTCF variants to bind (described in FIG. 17-21). We then looked at two variant binding sites with sequence that matched one of the five mutated binding sites (sequence depicted in FIG. 20) as well as known CBSs to determine if endogenous CTCF could bind to the wild-type CBS and not bind to the variant binding sites as the B2H reporter assay would suggest (FIG. 20). Human K562s, an erythroleukemia cell line, were harvested and analyzed by ChIP-qPCR using CTCF specific antibody to detect CTCF-DNA binding. Wild-type CTCF showed no detectable binding to two different target sites that matched the mutated CBS but showed great enrichment for wild-type CTCF binding site, supporting the results of the B2H reporter assay (FIG. 22). Next, we wanted to see if overexpressed, exogenous, 3×HA tagged wild-type CTCF delivered by plasmid transfection in K562s had the same binding profile observed with endogenous CTCF. Wild-type K562s were transfected with 3×HA-CTCF and 72 hours later were harvested and processed for ChIP-qPCR analysis with HA specific antibodies. Exogenous wild-type 3×HA-CTCF could bind to the wild-type CBSs and could not bind to the variant binding sites, same as endogenous wild-type CTCF, suggesting overexpression of CTCF by plasmid delivery reflects biologically relevant behavior (FIG. 23A). Based on these results, we next examined the ability of a variant CTCF to bind to the variant binding sites native to the human genome. The variant chosen was one pulled out from selection in the B2H selection assay and shown to bind to the variant site with the same sequence as variant site 1 and 2, used in FIGS. 22-23B, by the B2H reporter assay. K562s were transfected with the 3×HA-tagged CTCF variant and the same sites as before were examined for binding activity by ChIP-qPCR. Variant specific HA enrichment was present at the variant binding sites and lacking at the wild-type sites suggesting we successfully evolved a variant that can specifically bind to mutant CBS with as few as three nucleotide changes without binding native CBSs (FIG. 23B).

Gene Expression Regulation by Engineered CTCF Variants Via Looping

CTCF has the capacity to alter gene expression through CTCF-Cohesin mediated looping of the genome. We were curious to see if the variant CTCFs could reproduce the gene regulatory capacity of wild-type CTCF when bound to the endogenous variant binding sites. To investigate gene expression changes, we focused on genes within a 1 Mb region of the variant binding sites. Eleven genes were identified within 1 Mb region for Variant site 1.1 and 1.2 and another 10 genes were identified for Variant site 2.1 and 2.2. K562s were nucleofected with variant CTCFs fused to GFP that had the capacity to bind to Variant site 1 and Variant site 2. 72 hours post nucleofection, RNA was isolated from GFP+ cells and gene expression levels were compared to RNA extracted from K562s nucleofected with a wild-type CTCF control. Of the 11 genes for Variant site 1.1 and 1.2, 6 genes showed a change in gene expression relative to cells nucleofected with the wild-type CTCF control (JJ388) (FIG. 24A). 2 of the 10 genes identified for Variant site 2.1 and 2.2 had altered gene expression levels relative to wild-type control (FIG. 24B). This data suggests that not only do the variant CTCF proteins bind to their target sequence in human cells, but it also reproduces the biological role of native CTCF to regulate gene expression possibly through the formation of loops or sub-TADs.

Next we wanted to demonstrate that the CTCF variants could replicate the biological function of wild-type CTCF at a known CTCF binding site that creates an enhancer-promoter loop. MYC expression is maintained by a loop formed between a CTCF binding site ~2 kb upstream of the transcriptional start site (TSS) of MYC and a CTCF binding site ~1 kb downstream of the MYC TSS14. When CTCF Is bound to both sites, cohesin links both CTCFs via the CTCF's cohesin-interaction domain, creating a loop that maintains the expression of MYC. If one or both of the CTCF binding sites is disrupted the CTCF-mediated loop is lost and there is a reduction in MYC expression14. Five cell lines were generated containing the 5 different variant binding site sequences (defined in FIG. 25) at the CTCF binding site ~2 kb upstream of the MYC TSS. This was done in K562 background transduced with a lentiviral construct expressing exogenous MYC via phosphoglycerate kinase (PGK) promoter (exoMYC.K562) to compensate for any reduced cell fitness that reduction of endogenous MYC expression may cause. An additional sixth cell line was generated where point mutations to the CTCF binding site were made that should have no affect on wild-type CTCF binding as indicated by results from the B2H reporter assay. RNA was isolated from the clonal cell lines homozygous for the variant binding sites and endogenous MYC gene expression levels were assayed by reverse transcriptase Real Time qPCR (RT-qPCR). Each of the isolated cell lines with the variant CTCF binding site demonstrated a reduced level of MYC expression suggesting that the CTCF-mediated loop is disrupted (FIG. 25).

Based on this result, we wanted to see if expression of the variant CTCFs in these modified cell lines could bind to the engineered sites and restore MYC expression. HA tagged wild-type CTCF and HA tagged CTCF variants were expressed in the cell line that contained their matching variant binding site. Variants selected to bind to the G3 variant binding site were expressed in the G3_3 cell line, A3 variants in the A3_4 cell line, etc. HA-tagged wild-type CTCF was also tested in each of the variant cell lines for binding and for recovery of endogenous MYC expression. The level of endogenous MYC expression in exo-MYC.K562 served as wild-type control as there is no alteration to the CTCF binding site upstream of the MYC TSS. CTCF variants expressed in the engineered cell lines recovered endogenous MYC expression while expression of wild-type CTCF in these cell lines failed to recover MYC expression (FIGS. 26A-29). The same samples were analyzed for occupancy of the variant binding sites by wild-type CTCF or the variant CTCFs by ChIP-qPCR enriching for CTCF-bound DNA fragments with CTCF or HA antibody. Wild-type CTCF had a reduced occupancy of the variant binding sites, consistent with continued reduction of MYC expression, while variant CTCF proteins could bind to the variant site they were selected for as well as rescue MYC expression (FIG. 26-29). Together, this data suggests that we have evolved CTCF variants that can bind to novel sequences and still interact with cohesin to form loops that maintain gene expression profiles.

Tables

Amino acid sequence of variants selected for on different CTCF binding sites. All amino acids sequences are listed from N to C terminal. Colonies growing on the highest stringency of selection were scrapped off, pooled, and plasmid encoding for the zinc finger was isolated and deep sequenced. The number of reads reflects how prominent the variant was in the population pooled from selections performed in triplicate.

TABLE 1

ZF7 selection on C:G change at nt 2 of core motif in CBS. Sequences reflect position 2 through 6.

| SEQ ID NO: | Sequence | # reads |
|---|---|---|
| 8 | DHLQT | 2981 |
| 15 | EHLVV | 2413 |
| 155 | DHLNT | 1517 |
| 16 | DHLRT | 1442 |
| 13 | EHLKV | 1434 |
| 192 | KDLVV | 1357 |
| 193 | DHLQA | 1114 |
| 194 | DHLLV | 1076 |
| 195 | DHLLT | 881 |
| 196 | EHLTV | 803 |
| 197 | STLME | 786 |
| 17 | DHLAT | 777 |
| 9 | EHLNV | 736 |
| 12 | DHLQV | 574 |
| 198 | DHLKT | 541 |
| 199 | EHLKE | 517 |
| 200 | DHLLE | 506 |
| 201 | EHLRV | 503 |
| 202 | STLRE | 498 |
| 203 | DHLMV | 431 |
| 204 | DHLKV | 427 |

TABLE 1-continued

ZF7 selection on C:G change at nt 2 of core motif in CBS. Sequences reflect position 2 through 6.

| SEQ ID NO: | Sequence | # reads |
|---|---|---|
| 205 | DHLRV | 394 |
| 206 | DHLNV | 389 |
| 114 | DHLLA | 380 |
| 207 | DHLKE | 368 |
| 208 | DHLNE | 330 |
| 11 | EHLRE | 330 |
| 209 | STLLE | 323 |
| 210 | DHLMA | 305 |
| 211 | KDLTV | 296 |
| 212 | DHLVT | 284 |
| 213 | AHLNV | 270 |
| 214 | AHLTV | 268 |
| 215 | HTLME | 245 |
| 216 | DHLRA | 237 |
| 217 | DHLAV | 221 |
| 218 | HHLAE | 221 |
| 219 | GHLMD | 207 |
| 220 | DHLST | 199 |
| 221 | EHLMV | 197 |
| 222 | AHLVV | 196 |
| 223 | EHLAV | 192 |
| 224 | HTLAE | 187 |
| 225 | STLQE | 181 |
| 226 | DHLAE | 167 |
| 227 | AHLQE | 163 |
| 228 | SSLNE | 158 |
| 229 | GHLNV | 155 |
| 230 | EHLVE | 144 |
| 231 | DHLME | 143 |
| 232 | DHLRE | 134 |
| 233 | AHLNA | 120 |
| 234 | HTLVE | 120 |
| 235 | STLKE | 112 |
| 236 | EHLQV | 107 |
| 237 | GTLME | 106 |
| 238 | HHLAV | 102 |
| 239 | HSLME | 101 |
| 240 | HSLTE | 97 |
| 241 | EHLMA | 97 |
| 242 | DHLHT | 94 |
| 10 | AHLQV | 94 |
| 243 | DHLTV | 93 |
| 244 | EHLIV | 90 |
| 245 | SGLNE | 89 |
| 246 | AHLLV | 85 |
| 247 | EHLLV | 84 |
| 248 | VKLKI | 83 |
| 249 | DHLQE | 80 |
| 250 | HTLTE | 77 |
| 251 | STLHE | 76 |
| 252 | DHLVV | 76 |
| 253 | AGLAL | 70 |
| 254 | STLND | 69 |
| 255 | DHLKA | 68 |
| 256 | KDLTQ | 66 |
| 257 | DKLMN | 66 |
| 258 | GTLRE | 66 |
| 259 | GHLTV | 66 |
| 260 | RLLTA | 65 |
| 261 | SSLRE | 63 |
| 262 | HTLKE | 62 |
| 263 | GHLAV | 60 |
| 264 | RLLAQ | 58 |
| 265 | KDLAV | 57 |
| 266 | EHLQE | 57 |
| 267 | SHLNV | 57 |
| 268 | AGLPI | 57 |
| 269 | TTLME | 56 |
| 90 | AHLRV | 56 |
| 270 | AHLMV | 55 |

TABLE 1-continued

ZF7 selection on C:G change at nt 2 of core motif in CBS. Sequences reflect position 2 through 6.

| SEQ ID NO: | Sequence | # reads |
|---|---|---|
| 271 | EHLME | 55 |
| 272 | EHLQT | 55 |
| 273 | EVLNR | 55 |
| 274 | HHLVV | 54 |
| 275 | KDLSV | 54 |
| 276 | RHLVM | 53 |
| 277 | THLNE | 50 |
| 278 | RDLRT | 49 |
| 279 | LLLGS | 49 |
| 280 | MVLGN | 48 |
| 281 | KTLIE | 47 |
| 282 | AHLGV | 46 |
| 283 | SGLLA | 46 |
| 284 | DHLHV | 45 |
| 285 | EHLNT | 45 |
| 286 | STLLQ | 44 |
| 287 | AHLKV | 44 |
| 288 | AHLAV | 42 |
| 289 | TNLID | 41 |
| 290 | GTLNE | 41 |
| 291 | QVLTQ | 40 |
| 292 | SSLME | 39 |
| 293 | GHLVE | 38 |
| 294 | HSLLE | 38 |
| 295 | SGLLE | 38 |
| 296 | GGLLE | 36 |
| 297 | STLRV | 36 |
| 298 | HTLAD | 35 |
| 299 | SHLME | 35 |
| 300 | DHLAI | 35 |
| 301 | EHLLA | 35 |
| 302 | HNLLL | 34 |
| 303 | PHLVV | 34 |
| 304 | KALGT | 33 |
| 305 | PHLVI | 31 |
| 306 | VLLII | 30 |
| 307 | HHLRE | 29 |
| 308 | GALRM | 29 |
| 309 | RGLHE | 29 |
| 310 | AHLLE | 28 |
| 311 | EHLKA | 28 |
| 312 | DTLLV | 27 |
| 313 | EHLRT | 26 |
| 314 | SSLRD | 24 |
| 156 | EHLQA | 23 |
| 315 | EHLAT | 23 |
| 316 | SGLGE | 22 |
| 317 | ATLQE | 22 |
| 318 | DHLSA | 22 |
| 101 | SNLLV | 22 |
| 319 | SHLLV | 21 |
| 320 | KDLMV | 21 |
| 321 | DHLQQ | 20 |
| 322 | ATLME | 20 |
| 323 | GHLQA | 20 |
| 324 | RTLTE | 20 |
| 325 | RRLAH | 20 |
| 326 | DTLQA | 20 |
| 327 | GHLEV | 19 |
| 328 | HQLKL | 19 |
| 329 | EHLLT | 19 |
| 330 | DGLRT | 18 |
| 331 | THLRP | 18 |
| 132 | DNLAT | 18 |
| 332 | EHLNA | 17 |
| 333 | STLVV | 17 |
| 135 | DNLMT | 17 |
| 334 | DTLLA | 17 |
| 335 | STLDE | 16 |
| 336 | KDLVA | 15 |

TABLE 1-continued

ZF7 selection on C:G change at nt 2 of core motif in CBS. Sequences reflect position 2 through 6.

| SEQ ID NO: | Sequence | # reads |
|---|---|---|
| 337 | AHLHA | 15 |
| 338 | KDLQV | 15 |
| 339 | HHLTV | 15 |
| 340 | SGLLD | 15 |
| 341 | ANLME | 14 |
| 129 | DNLLV | 14 |
| 342 | EHLKT | 13 |
| 343 | GSLAI | 13 |
| 344 | EHLSV | 13 |
| 345 | EHLNE | 13 |
| 346 | EHLVI | 13 |
| 347 | KDLKV | 13 |
| 348 | EGLGT | 13 |
| 130 | DNLQT | 12 |
| 349 | STLMS | 12 |
| 350 | AHLMM | 12 |
| 351 | IKLDG | 12 |
| 352 | VLLGA | 12 |
| 353 | PGLSA | 12 |
| 354 | AELNR | 12 |
| 355 | HQLVI | 12 |
| 356 | GHLVV | 12 |
| 357 | PHLLV | 11 |
| 358 | PRLAL | 11 |
| 359 | DHLNA | 11 |
| 360 | KDLDV | 11 |
| 361 | AHLHV | 11 |
| 362 | RVLGG | 11 |
| 363 | AHLQA | 11 |
| 364 | RQLRT | 10 |
| 365 | AHLQT | 10 |
| 100 | DNLLA | 10 |
| 151 | EHLAE | 10 |
| 366 | EHLAM | 10 |
| 367 | DRLSI | 10 |
| 368 | GGLGA | 10 |
| 369 | GHLNT | 10 |
| 370 | AHLRT | 10 |
| 371 | DTLRV | 10 |
| 372 | MSLRG | 9 |
| 373 | DHLTI | 9 |
| 374 | THLIV | 9 |
| 375 | DTLMA | 9 |
| 376 | MKLQE | 9 |
| 377 | TALGT | 9 |
| 378 | GHLLV | 9 |
| 379 | GQLAI | 8 |
| 380 | ANLES | 8 |
| 381 | AHLNT | 8 |
| 382 | EHLLE | 8 |
| 383 | SNLTV | 8 |
| 384 | STLLV | 8 |
| 385 | STLMV | 8 |
| 386 | GTLVS | 7 |
| 387 | DNLKT | 7 |
| 388 | GHLQT | 7 |
| 128 | DNLLT | 7 |
| 389 | EHLVT | 7 |
| 390 | GALRE | 7 |
| 391 | SSLAE | 7 |
| 392 | DTLRQ | 7 |
| 393 | KALLG | 7 |
| 394 | AMLNP | 6 |
| 395 | DTLHQ | 6 |
| 396 | DNLLQ | 6 |
| 397 | EHLAH | 6 |
| 398 | AHLKE | 6 |
| 399 | ATLAE | 6 |
| 400 | EHLMD | 6 |
| 401 | STLHM | 6 |

TABLE 1-continued

ZF7 selection on C:G change at nt 2 of core motif in CBS. Sequences reflect position 2 through 6.

| SEQ ID NO: | Sequence | # reads |
|---|---|---|
| 402 | DTLAV | 6 |
| 403 | DHLVE | 6 |
| 404 | PTLGE | 6 |
| 405 | KGLPL | 6 |
| 406 | DTLLQ | 6 |
| 407 | AHLNE | 6 |
| 408 | AHLAE | 6 |
| 409 | GHLKV | 6 |
| 410 | SGLQV | 5 |
| 411 | HHLLV | 5 |
| 412 | EPLLP | 5 |
| 413 | DNLAV | 5 |
| 414 | AHLLT | 5 |
| 415 | AHLST | 5 |
| 133 | DNLQA | 5 |
| 416 | DNLRT | 5 |
| 417 | DTLAL | 5 |
| 418 | DTLQV | 5 |
| 419 | EHLRA | 5 |
| 420 | SNLQV | 5 |
| 421 | KDLRV | 5 |
| 422 | DTLAT | 5 |
| 423 | DTLRA | 5 |
| 424 | QHLRV | 4 |
| 425 | SSLLE | 4 |
| 426 | SNLMV | 4 |
| 427 | SDLGG | 4 |
| 428 | DNLHT | 4 |
| 429 | DNLTA | 4 |
| 430 | DTLMV | 4 |
| 431 | EHLST | 4 |
| 432 | DTLSV | 4 |
| 102 | DNLMA | 4 |
| 433 | EHLVM | 4 |
| 434 | STLAE | 4 |

TABLE 1-continued

ZF7 selection on C:G change at nt 2 of core motif in CBS. Sequences reflect position 2 through 6.

| SEQ ID NO: | Sequence | # reads |
|---|---|---|
| 435 | KDLAE | 4 |
| 436 | SSLNV | 4 |
| 437 | SSLLV | 4 |
| 438 | AHLKT | 4 |
| 439 | AHLRE | 4 |
| 440 | KDLLV | 4 |

TABLE 2

ZF7 selection on C:T change at nt 2 of core motif in CBS. Sequences reflect position 2 through 6.

| SEQ ID NO: | Sequence | Read # |
|---|---|---|
| 312 | DTLLV | 3772 |
| 334 | DTLLA | 1720 |
| 406 | DTLLQ | 1681 |
| 326 | DTLQA | 1340 |
| 371 | DTLRV | 1048 |
| 418 | DTLQV | 715 |
| 423 | DTLRA | 643 |
| 375 | DTLMA | 620 |
| 430 | DTLMV | 538 |
| 402 | DTLAV | 451 |
| 422 | DTLAT | 406 |
| 441 | DSLLV | 373 |
| 432 | DTLSV | 359 |
| 442 | DTLLM | 339 |
| 392 | DTLRQ | 334 |
| 443 | DTLLI | 306 |
| 444 | DTLTQ | 300 |
| 434 | STLAE | 269 |
| 445 | DTLAA | 268 |
| 395 | DTLHQ | 246 |
| 446 | DTLSA | 227 |
| 447 | DTLKA | 216 |

TABLE 2-continued

ZF7 selection on C:T change at nt 2 of core motif in CBS. Sequences reflect position 2 through 6.

| SEQ ID NO: | Sequence | Read # |
|---|---|---|
| 384 | STLLV | 213 |
| 448 | STLQQ | 201 |
| 449 | DTLQQ | 200 |
| 450 | DTLLL | 194 |
| 451 | DTLMQ | 189 |
| 225 | STLQE | 189 |
| 452 | DTLNA | 180 |
| 453 | STLLA | 176 |
| 454 | DTLKV | 163 |
| 455 | STLNA | 162 |
| 456 | DTLRE | 161 |
| 457 | DTLTA | 152 |
| 458 | DTLQD | 146 |
| 459 | DTLVA | 137 |
| 460 | DTLLS | 123 |
| 461 | STLTQ | 122 |
| 462 | DSLLA | 116 |
| 463 | DTLRT | 116 |
| 464 | DTLQI | 115 |
| 465 | DTLMN | 114 |
| 466 | STLSE | 114 |
| 467 | SSLQV | 112 |
| 468 | TNLAV | 109 |
| 469 | DTLVV | 108 |
| 470 | DTLHA | 107 |
| 471 | DTLMT | 107 |
| 437 | SSLLV | 107 |
| 209 | STLLE | 107 |
| 472 | DSLRV | 106 |
| 473 | DTLAE | 105 |
| 474 | STLNV | 105 |
| 475 | DTLRN | 101 |
| 476 | DTLNV | 100 |
| 477 | DTLRD | 99 |
| 478 | DSLAV | 94 |
| 479 | DTLVQ | 94 |
| 480 | DTLQE | 93 |
| 481 | STLLD | 92 |
| 482 | DTLTH | 89 |
| 483 | SSLND | 88 |
| 484 | STLTV | 88 |
| 385 | STLMV | 87 |
| 485 | DTLML | 86 |
| 286 | STLLQ | 85 |
| 202 | STLRE | 85 |
| 486 | STLQA | 84 |
| 487 | DTLLD | 83 |
| 488 | DTLKQ | 82 |
| 489 | DTLLT | 81 |
| 417 | DTLAL | 76 |
| 490 | DTLII | 75 |
| 491 | DTLLN | 75 |
| 492 | DSLLQ | 73 |
| 493 | STLEQ | 73 |
| 494 | DTLGV | 71 |
| 495 | DVLRE | 67 |
| 496 | STLSA | 66 |
| 497 | DSLSV | 65 |
| 498 | DTLLE | 63 |
| 499 | STLAA | 63 |
| 500 | DTLKI | 62 |
| 501 | DTLKM | 62 |
| 502 | DTLQN | 60 |
| 197 | STLME | 60 |
| 503 | TTLMT | 60 |
| 504 | TTLAE | 59 |
| 505 | STLTE | 58 |
| 506 | VELVQ | 57 |
| 507 | TTLNQ | 56 |
| 508 | DTLMI | 54 |
| 509 | TTLMD | 54 |

TABLE 2-continued

ZF7 selection on C:T change at nt 2 of core motif in CBS. Sequences reflect position 2 through 6.

| SEQ ID NO: | Sequence | Read # |
|---|---|---|
| 510 | STLMA | 51 |
| 511 | DVLLA | 50 |
| 512 | DVLLT | 49 |
| 235 | STLKE | 49 |
| 513 | TTLNE | 49 |
| 514 | MTLPT | 48 |
| 292 | SSLME | 48 |
| 251 | STLHE | 48 |
| 515 | HTLVV | 47 |
| 269 | TTLME | 46 |
| 516 | ATLTQ | 45 |
| 517 | STLAS | 45 |
| 333 | STLVV | 44 |
| 425 | SSLLE | 43 |
| 518 | SSLVE | 42 |
| 519 | DALQA | 41 |
| 520 | DVLDA | 41 |
| 521 | GSLMQ | 41 |
| 522 | DTLTM | 40 |
| 523 | STLAQ | 39 |
| 524 | STLMI | 38 |
| 525 | DTLAM | 37 |
| 526 | DTLHT | 37 |
| 527 | DTLQL | 37 |
| 528 | DSLKQ | 36 |
| 529 | DSLRA | 36 |
| 530 | STLHV | 35 |
| 531 | STLMQ | 35 |
| 532 | DGLMA | 34 |
| 533 | DTLRL | 34 |
| 534 | SSLLT | 34 |
| 535 | DSLQA | 33 |
| 536 | DTLRI | 33 |
| 537 | STLGE | 33 |
| 538 | DALKE | 32 |
| 539 | STLRA | 31 |
| 540 | DTLHH | 30 |
| 541 | DTLRG | 30 |
| 542 | DTLRM | 30 |
| 543 | DVLMT | 30 |
| 544 | DTLEI | 29 |
| 228 | SSLNE | 29 |
| 545 | DTLHV | 28 |
| 546 | GTLDE | 28 |
| 547 | SSLAV | 28 |
| 548 | STLKQ | 28 |
| 549 | DTLMD | 27 |
| 550 | GTLQT | 27 |
| 551 | SSLVQ | 27 |
| 297 | STLRV | 27 |
| 552 | LMLMG | 25 |
| 553 | STLRQ | 25 |
| 554 | STLTA | 25 |
| 8 | DHLQT | 24 |
| 555 | DSLVA | 23 |
| 556 | SSLRV | 23 |
| 557 | DSLRE | 22 |
| 558 | GRLQD | 22 |
| 559 | MALQD | 22 |
| 560 | STLLH | 21 |
| 561 | STLVQ | 21 |
| 562 | VRLTA | 21 |
| 563 | AVLGD | 20 |
| 564 | PILVT | 20 |
| 565 | STLDD | 20 |
| 566 | DSLMI | 19 |
| 567 | STLID | 19 |
| 568 | TKLDT | 19 |
| 569 | ATLVA | 18 |
| 570 | DTLIA | 18 |
| 571 | DTLTE | 18 |

TABLE 2-continued

ZF7 selection on C:T change at nt 2 of core motif in CBS. Sequences reflect position 2 through 6.

| SEQ ID NO: | Sequence | Read # |
|---|---|---|
| 572 | GTLNH | 17 |
| 573 | STLAI | 17 |
| 282 | AHLGV | 16 |
| 129 | DNLLV | 16 |
| 574 | DQLVQ | 16 |
| 575 | MPLIL | 16 |
| 576 | TTLHQ | 16 |
| 577 | TTLQV | 16 |
| 578 | ATLLE | 15 |
| 579 | DVLHE | 15 |
| 580 | ETLRA | 15 |
| 581 | KVLRS | 15 |
| 101 | SNLLV | 15 |
| 135 | DNLMT | 14 |
| 582 | DSLRQ | 14 |
| 583 | DTLAN | 14 |
| 584 | GTLNV | 14 |
| 585 | HNLMV | 14 |
| 586 | QTLQA | 14 |
| 587 | RQLTT | 14 |
| 588 | DTLSI | 13 |
| 589 | DRLVG | 12 |
| 590 | ETLRQ | 12 |
| 591 | SSLGE | 12 |
| 592 | SSLVV | 12 |
| 193 | DHLQA | 11 |
| 128 | DNLLT | 11 |
| 593 | DTLME | 11 |
| 594 | DTLTV | 11 |
| 595 | DTLVG | 11 |
| 596 | ETLKA | 11 |
| 597 | GVLSQ | 11 |
| 598 | LALMR | 11 |
| 599 | RTLVE | 11 |
| 600 | TTLLI | 11 |
| 601 | TTLNV | 11 |

TABLE 2-continued

ZF7 selection on C:T change at nt 2 of core motif in CBS. Sequences reflect position 2 through 6.

| SEQ ID NO: | Sequence | Read # |
|---|---|---|
| 602 | DTLSE | 10 |
| 391 | SSLAE | 10 |
| 603 | STLAV | 10 |

TABLE 3

ZF7 selection on C:A change at nt 2 of core motif in CBS. Sequences reflect position 2 through 6.

| SEQ ID NO: | Sequence | # read |
|---|---|---|
| 100 | DNLLA | 2659 |
| 101 | SNLLV | 2616 |
| 135 | DNLMT | 2555 |
| 130 | DNLQT | 1983 |
| 129 | DNLLV | 1945 |
| 128 | DNLLT | 1922 |
| 132 | DNLAT | 1457 |
| 604 | DNLRA | 1117 |
| 102 | DNLMA | 1038 |
| 605 | DNLMV | 901 |
| 606 | DNLQV | 845 |
| 607 | DNLQQ | 841 |
| 396 | DNLLQ | 813 |
| 387 | DNLKT | 582 |
| 133 | DNLQA | 571 |
| 420 | SNLQV | 565 |
| 608 | DNLRQ | 494 |
| 426 | SNLMV | 459 |
| 383 | SNLTV | 458 |
| 609 | DNLNT | 412 |
| 428 | DNLHT | 389 |
| 610 | SNLVV | 349 |
| 611 | SNLQQ | 334 |
| 429 | DNLTA | 323 |
| 612 | DNLLS | 322 |

TABLE 3-continued

ZF7 selection on C:A change at nt 2 of core motif in CBS. Sequences reflect position 2 through 6.

| SEQ ID NO: | Sequence | # read |
| --- | --- | --- |
| 413 | DNLAV | 316 |
| 416 | DNLRT | 309 |
| 613 | DNLTT | 300 |
| 614 | DNLAA | 295 |
| 615 | SNLLA | 295 |
| 616 | SNLLQ | 278 |
| 617 | SNLAV | 257 |
| 618 | DNLNA | 240 |
| 619 | DNLGT | 240 |
| 103 | DNLRV | 239 |
| 620 | DNLKA | 167 |
| 621 | DNLMQ | 156 |
| 622 | DNLKV | 148 |
| 623 | SNLNV | 132 |
| 624 | SNLMA | 128 |
| 625 | SVLQD | 113 |
| 626 | DNLQS | 110 |
| 627 | DNLSA | 105 |
| 628 | DNLAQ | 103 |
| 629 | DNLMS | 98 |
| 630 | DNLSQ | 95 |
| 631 | DNLNV | 87 |
| 632 | DNLGV | 87 |
| 633 | SNLLT | 87 |
| 634 | DNLIA | 83 |
| 635 | DNLNQ | 83 |
| 636 | SNLQT | 80 |
| 637 | SNLRV | 79 |
| 638 | SNLIV | 79 |
| 639 | DNLSV | 74 |
| 640 | SNLQA | 60 |
| 641 | SNLLL | 57 |
| 642 | SNLDV | 56 |
| 643 | DNLVQ | 54 |
| 644 | SNLLI | 54 |
| 645 | TGLAL | 52 |
| 646 | SNLMQ | 51 |
| 647 | DQLKI | 40 |
| 648 | GDLGT | 40 |
| 649 | SNLKV | 39 |
| 650 | VPLVD | 38 |
| 651 | DNLRI | 37 |
| 652 | DNLLI | 37 |
| 653 | TNLDV | 36 |
| 654 | HDLKI | 35 |
| 655 | DNLVV | 35 |
| 312 | DTLLV | 32 |
| 656 | DNLTV | 31 |
| 657 | DNLVT | 31 |
| 658 | SNLAQ | 30 |
| 659 | DNLIV | 28 |
| 660 | SNLMT | 27 |
| 465 | DTLMN | 25 |
| 661 | SNLTQ | 23 |
| 662 | EILRI | 23 |
| 663 | IGLEA | 22 |
| 664 | HRLGG | 22 |
| 8 | DHLQT | 21 |
| 665 | DNLST | 20 |
| 666 | MRLHV | 19 |
| 667 | SNLTT | 18 |
| 668 | SNLGV | 16 |
| 669 | SNLAT | 16 |
| 15 | EHLVV | 16 |
| 670 | ANLMV | 14 |
| 671 | HVLVG | 14 |
| 672 | SNLRA | 13 |
| 673 | HNLQL | 12 |
| 674 | DNLVA | 12 |
| 675 | SNLTA | 12 |
| 676 | KGLRM | 12 |

TABLE 3-continued

ZF7 selection on C:A change at nt 2 of core motif in CBS. Sequences reflect position 2 through 6.

| SEQ ID NO: | Sequence | # read |
|---|---|---|
| 334 | DTLLA | 12 |
| 677 | PMLGV | 11 |
| 678 | GVLVA | 11 |
| 679 | DNLQD | 11 |
| 680 | MKLGT | 11 |
| 406 | DTLLQ | 11 |

TABLE 4

ZF7 selection on A:T change at nt 3 of core motif in CBS. Sequences reflect position −1 to 3.

| SEQ ID NO: | Sequence | # Reads |
|---|---|---|
| 173 | RKHD | 4641 |
| 175 | RKAD | 1938 |
| 174 | RRSD | 1299 |
| 681 | RRHD | 868 |
| 682 | RKTD | 182 |
| 683 | NVSM | 146 |
| 684 | RQSD | 76 |
| 685 | RKND | 69 |
| 686 | SENV | 69 |
| 687 | VDHR | 60 |
| 688 | AQIV | 58 |
| 689 | KTPH | 56 |
| 690 | PKIV | 51 |
| 691 | GAEP | 42 |
| 692 | MLVE | 40 |
| 693 | VVGN | 40 |
| 694 | KGPE | 36 |
| 695 | GKVM | 33 |
| 696 | TEPG | 33 |
| 697 | TPHN | 32 |
| 698 | MPGG | 31 |
| 699 | DLEK | 28 |
| 700 | GTDN | 27 |

TABLE 4-continued

ZF7 selection on A:T change at nt 3 of core motif in CBS. Sequences reflect position −1 to 3.

| SEQ ID NO: | Sequence | # Reads |
|---|---|---|
| 701 | ISRL | 25 |
| 702 | ATGL | 21 |
| 703 | ASNP | 19 |
| 704 | GAPT | 17 |
| 705 | HSPN | 17 |
| 706 | RPVA | 16 |
| 177 | RKDD | 6 |
| 707 | MLVD | 4 |
| 708 | RHRK | 3 |
| 709 | RKHV | 3 |
| 710 | RKQD | 3 |
| 711 | RKSD | 3 |
| 712 | DHHT | 2 |
| 713 | GKHD | 2 |
| 714 | MKAD | 2 |
| 715 | RKAE | 2 |
| 716 | RRAD | 2 |
| 717 | APIG | 1 |
| 718 | AQNR | 1 |
| 719 | DMDA | 1 |
| 720 | EAPM | 1 |
| 721 | EEMM | 1 |
| 722 | EPIR | 1 |
| 723 | GALE | 1 |
| 724 | GENV | 1 |
| 725 | GKAD | 1 |
| 726 | GKVD | 1 |
| 727 | GPLA | 1 |
| 728 | GRIE | 1 |
| 729 | IEKL | 1 |
| 730 | KAAS | 1 |
| 731 | KEEH | 1 |
| 732 | LKVD | 1 |
| 733 | LLVE | 1 |
| 734 | LMTQ | 1 |
| 735 | MASL | 1 |

TABLE 4-continued

ZF7 selection on A:T change at nt 3 of core motif in CBS.
Sequences reflect position -1 to 3.

| SEQ ID NO: | Sequence | # Reads |
|---|---|---|
| 736 | MGIG | 1 |
| 737 | MPGD | 1 |
| 738 | MSLG | 1 |
| 739 | NDMT | 1 |
| 740 | NMHT | 1 |
| 741 | NRIV | 1 |
| 742 | PENA | 1 |
| 743 | QKHD | 1 |
| 744 | QVPD | 1 |
| 745 | RASD | 1 |
| 746 | REHD | 1 |
| 747 | RGHD | 1 |
| 748 | RKHA | 1 |
| 749 | RKHY | 1 |
| 750 | RKLD | 1 |
| 751 | RKPD | 1 |
| 752 | RKVD | 1 |
| 753 | RKYD | 1 |
| 754 | RMSD | 1 |
| 755 | RRLD | 1 |
| 756 | RRND | 1 |
| 757 | RRRD | 1 |
| 758 | RRSG | 1 |
| 759 | RWHD | 1 |
| 760 | SHRL | 1 |
| 761 | SQHV | 1 |
| 762 | SSHD | 1 |
| 763 | TTHV | 1 |
| 764 | VHHV | 1 |
| 765 | WKAD | 1 |
| 766 | WKHD | 1 |

TABLE 5

ZF7 selection on A:G change at nt 3 of core motif in CBS.
Sequences reflect position -1 to 3.

| SEQ ID NO: | Sequence | Read # |
|---|---|---|
| 174 | RRSD | 2997 |
| 173 | RKHD | 2731 |
| 175 | RKAD | 1867 |
| 177 | RKDD | 667 |
| 682 | RKTD | 475 |
| 767 | HADA | 411 |
| 710 | RKQD | 376 |
| 768 | RKWD | 296 |
| 745 | RASD | 265 |
| 681 | RRHD | 169 |
| 685 | RKND | 126 |
| 754 | RMSD | 40 |
| 769 | RKGD | 5 |
| 743 | QKHD | 3 |
| 757 | RRRD | 3 |
| 711 | RKSD | 3 |
| 752 | RKVD | 2 |
| 180 | QALL | 2 |
| 753 | RKYD | 2 |
| 756 | RRND | 2 |
| 720 | EAPM | 1 |
| 770 | RRCD | 1 |
| 771 | MLPA | 1 |
| 772 | RATD | 1 |
| 773 | RKDV | 1 |
| 774 | KKPV | 1 |
| 775 | GEHG | 1 |
| 776 | HPVR | 1 |
| 777 | RQHD | 1 |
| 778 | RMMQ | 1 |
| 779 | RRGD | 1 |
| 780 | GREV | 1 |
| 781 | REQD | 1 |
| 782 | DRDM | 1 |
| 783 | SKHD | 1 |
| 784 | RLSD | 1 |

TABLE 5-continued

ZF7 selection on A:G change at nt 3 of core motif in CBS.
Sequences reflect position -1 to 3.

| SEQ ID NO: | Sequence | Read # |
|---|---|---|
| 785 | VPTV | 1 |
| 786 | HKWD | 1 |
| 787 | KKND | 1 |
| 788 | RRSE | 1 |
| 749 | RKHY | 1 |
| 789 | READ | 1 |
| 790 | RNTD | 1 |
| 791 | MVRA | 1 |
| 792 | RKED | 1 |
| 793 | KTMG | 1 |
| 794 | NEPN | 1 |
| 795 | RGSD | 1 |
| 796 | RKRD | 1 |
| 797 | RWSD | 1 |
| 798 | TPLP | 1 |
| 799 | RKAN | 1 |
| 800 | RKAY | 1 |
| 801 | QLPL | 1 |
| 709 | RKHV | 1 |
| 802 | QGTS | 1 |
| 803 | DTMV | 1 |
| 804 | LKWD | 1 |
| 805 | MNTL | 1 |
| 806 | HADV | 1 |
| 697 | TPHN | 1 |
| 750 | RKLD | 1 |
| 807 | GRAH | 1 |
| 704 | GAPT | 1 |
| 808 | MKHD | 1 |
| 809 | HEDA | 1 |
| 712 | DHHT | 1 |
| 810 | RMLS | 1 |
| 811 | WRSD | 1 |
| 812 | DDAT | 1 |
| 735 | MASL | 1 |
| 730 | KAAS | 1 |

TABLE 6

ZF7 selection on A:C change at nt 3 of core motif in CBS.
Sequences reflect position -1 to 3.

| SEQ ID NO: | Sequence | Read # |
|---|---|---|
| 173 | RKHD | 9 |
| 813 | DTEN | 6 |
| 775 | GEHG | 5 |
| 814 | STKN | 5 |
| 815 | NIEI | 5 |
| 801 | QLPL | 4 |
| 780 | GREV | 4 |
| 712 | DHHT | 4 |
| 782 | DRDM | 4 |
| 816 | MVIN | 4 |
| 817 | VPDT | 4 |
| 818 | NIVP | 4 |
| 819 | MVPS | 4 |
| 820 | PNHP | 4 |
| 821 | KTDV | 4 |
| 794 | NEPN | 3 |
| 760 | SHRL | 3 |
| 736 | MGIG | 3 |
| 822 | HIKM | 3 |
| 823 | ILQI | 3 |
| 741 | NRIV | 3 |
| 824 | IVMQ | 3 |
| 825 | QTNS | 3 |
| 826 | ENMD | 3 |
| 827 | TVER | 3 |
| 828 | THDR | 3 |
| 829 | IRSP | 3 |
| 771 | MLPA | 3 |
| 721 | EEMM | 2 |
| 830 | ARIA | 2 |
| 785 | VPTV | 2 |
| 831 | EELI | 2 |
| 832 | KPLR | 2 |
| 812 | DDAT | 2 |
| 833 | NRLS | 2 |
| 834 | PTLR | 2 |

TABLE 6-continued

ZF7 selection on A:C change at nt 3 of core motif in CBS.
Sequences reflect position -1 to 3.

| SEQ ID NO: | Sequence | Read # |
|---|---|---|
| 835 | MHIL | 2 |
| 836 | GGGP | 2 |
| 837 | MVEN | 2 |
| 719 | DMDA | 2 |
| 838 | IVAT | 2 |
| 839 | TLDR | 2 |
| 840 | MEPL | 2 |
| 841 | DTGV | 2 |
| 842 | TSRS | 2 |
| 843 | VLSI | 2 |
| 844 | STVQ | 2 |
| 845 | GPAQ | 2 |
| 846 | VEQP | 2 |
| 847 | MTKK | 2 |
| 848 | PLIM | 2 |
| 802 | QGTS | 2 |
| 849 | AMTV | 2 |
| 850 | SPMR | 2 |
| 851 | EPNV | 2 |
| 735 | MASL | 2 |
| 852 | MQIN | 2 |
| 853 | ALDE | 2 |
| 728 | GRIE | 2 |
| 854 | ALEH | 2 |
| 855 | REKD | 2 |
| 856 | ELLA | 2 |
| 857 | GVAR | 2 |
| 858 | VDTL | 2 |
| 859 | GHEN | 2 |
| 730 | KAAS | 2 |
| 860 | ELES | 2 |
| 861 | DPDT | 2 |
| 862 | SLEL | 2 |
| 863 | TMNV | 2 |
| 764 | VHHV | 2 |
| 864 | IQPV | 2 |

TABLE 6-continued

ZF7 selection on A:C change at nt 3 of core motif in CBS.
Sequences reflect position -1 to 3.

| SEQ ID NO: | Sequence | Read # |
|---|---|---|
| 865 | MLQE | 1 |
| 866 | VMTV | 1 |
| 867 | MVEE | 1 |
| 868 | VARP... | 1 |
| 869 | KAIG | 1 |
| 870 | DRSM | 1 |
| 871 | KNSI | 1 |
| 872 | DDVS | 1 |
| 873 | KPQP | 1 |
| 874 | PHVP | 1 |
| 875 | DTLQ | 1 |
| 876 | KLGT | 1 |
| 877 | IDPH | 1 |
| 878 | HPNT | 1 |
| 879 | KSRG | 1 |
| 880 | RQMA | 1 |
| 881 | KKEN | 1 |
| 882 | QVLD | 1 |
| 722 | EPIR | 1 |
| 883 | RRQM | 1 |
| 798 | TPLP | 1 |
| 884 | ILKN | 1 |
| 885 | HQMK | 1 |
| 179 | ELLN | 1 |
| 886 | MDGG | 1 |
| 887 | AAGS | 1 |
| 888 | STVV | 1 |
| 889 | PARA | 1 |
| 890 | ALQG | 1 |
| 891 | SAPG | 1 |
| 892 | PVLN | 1 |
| 742 | PENA | 1 |
| 893 | TSLL | 1 |
| 731 | KEEH | 1 |
| 894 | HLDV | 1 |
| 895 | IHIR | 1 |

TABLE 6-continued

ZF7 selection on A:C change at nt 3 of core motif in CBS. Sequences reflect position -1 to 3.

| SEQ ID NO: | Sequence | Read # |
|---|---|---|
| 896 | SVTL | 1 |
| 897 | VKDR | 1 |
| 898 | KMTI | 1 |
| 899 | AGEM | 1 |
| 900 | GDSE | 1 |
| 901 | QPVK | 1 |
| 902 | KVEA | 1 |
| 903 | EQER | 1 |
| 729 | IEKL | 1 |
| 904 | GHHV | 1 |
| 905 | GMHL | 1 |
| 906 | RLRR | 1 |
| 907 | ATIR | 1 |
| 908 | RMDI | 1 |
| 909 | SVIH | 1 |
| 910 | MDIG | 1 |
| 911 | LART | 1 |
| 912 | RLMA | 1 |
| 913 | RQPP | 1 |
| 914 | MTMT | 1 |
| 915 | EDTR | 1 |
| 739 | NDMT | 1 |
| 916 | MRGR | 1 |
| 917 | ELHA | 1 |
| 918 | TNGQ | 1 |
| 919 | VNLT | 1 |
| 920 | MHIR | 1 |
| 921 | MLLQ | 1 |
| 922 | GRGE | 1 |
| 923 | NLRG | 1 |
| 924 | HIML | 1 |
| 807 | GRAH | 1 |
| 805 | MNTL | 1 |
| 763 | TTHV | 1 |
| 793 | KTMG | 1 |
| 925 | MTSV | 1 |
| 926 | RLSM | 1 |
| 803 | DTMV | 1 |
| 720 | EAPM | 1 |
| 927 | DMGM | 1 |
| 928 | MLMM | 1 |
| 929 | LMEM | 1 |
| 930 | QAVS | 1 |
| 931 | SRVL | 1 |
| 932 | DEDP | 1 |
| 933 | SGDR | 1 |
| 934 | MMNC | 1 |
| 935 | NIGM | 1 |
| 936 | MVQR | 1 |
| 937 | APHR | 1 |
| 938 | LDAG | 1 |
| 939 | RLAN | 1 |
| 940 | MKGS | 1 |
| 941 | KKLV | 1 |
| 942 | VNQE | 1 |
| 943 | ILKQ | 1 |
| 944 | PVIP | 1 |
| 945 | VESL | 1 |
| 946 | IKQN | 1 |
| 947 | EDNI | 1 |
| 948 | THRD | 1 |
| 949 | IPAG | 1 |
| 950 | GLNH | 1 |
| 951 | VDGR | 1 |
| 181 | PHRM | 1 |
| 952 | RTGA | 1 |
| 953 | VSPD | 1 |
| 954 | KVGD | 1 |

TABLE 7

ZF6 selection on C:T change at nt 5 of core motif in CBS.
Sequences reflect position 2 to 6.

| SEQ ID NO: | Sequence | Read # |
|---|---|---|
| 955 | GHMRR | 29 |
| 956 | GHMNR | 23 |
| 34 | EHMRR | 23 |
| 957 | THMRR | 19 |
| 33 | THMKR | 17 |
| 126 | EHMNR | 17 |
| 958 | GHMKR | 12 |
| 127 | EHMAR | 11 |
| 959 | EHMQR | 10 |
| 147 | SHMRR | 10 |
| 960 | SAMRR | 9 |
| 961 | ENMGR | 8 |
| 962 | SHMKR | 8 |
| 35 | THMNR | 7 |
| 963 | NHMRR | 7 |
| 964 | EGMRR | 7 |
| 965 | GNMGR | 7 |
| 146 | SHMNR | 6 |
| 966 | NGMRI | 6 |
| 967 | EGMAR | 6 |
| 968 | ESMRR | 6 |
| 969 | GHMSR | 5 |
| 970 | EGMHR | 5 |
| 971 | TAMRR | 5 |
| 972 | TNMQR | 5 |
| 973 | VNMRR | 5 |
| 974 | AHMKR | 4 |
| 975 | NGMTA | 4 |
| 976 | DGMRR | 4 |
| 977 | GHMTR | 4 |
| 978 | EHMSR | 4 |
| 123 | EHMKR | 4 |
| 979 | GSMRR | 4 |
| 980 | TNMLR | 4 |
| 981 | NHMKR | 4 |
| 982 | ENMLR | 4 |
| 983 | SPMGV | 3 |
| 984 | TNMGR | 3 |
| 985 | SSMAR | 3 |
| 986 | GGMRR | 3 |
| 987 | GGMKL | 3 |
| 988 | SGMVR | 3 |
| 989 | EHMHR | 3 |
| 990 | THMSR | 3 |
| 991 | GSMKI | 3 |
| 992 | EKMKE | 3 |
| 993 | NGMAR | 3 |
| 994 | QNMVR | 3 |
| 995 | DNMRR | 3 |
| 996 | ENMER | 3 |
| 997 | NSMRR | 3 |
| 998 | SGMKR | 3 |
| 999 | ANMQR | 3 |
| 1000 | GHMQR | 3 |
| 1001 | ANMGR | 3 |
| 1002 | DNMVR | 3 |
| 1003 | QAMRE | 2 |
| 1004 | GNMSR | 2 |
| 1005 | ESMQR | 2 |
| 1006 | TPMKV | 2 |
| 1007 | SNMGR | 2 |
| 1008 | GAMRI | 2 |
| 1009 | ANMNR | 2 |
| 1010 | DNMMR | 2 |
| 1011 | GSMKM | 2 |
| 31 | EHMGR | 2 |
| 1012 | GNMAQ | 2 |
| 1013 | EGMKG | 2 |
| 1014 | SSMKI | 2 |
| 1015 | TSMRR | 2 |
| 1016 | DGMKR | 2 |
| 1017 | DNMAR | 2 |

TABLE 7-continued

ZF6 selection on C:T change at nt 5 of core motif in CBS.
Sequences reflect position 2 to 6.

| SEQ ID NO: | Sequence | Read # |
|---|---|---|
| 1018 | SSMRR | 2 |
| 1019 | GNMMR | 2 |
| 185 | NAMRG | 2 |
| 1020 | THMKL | 2 |
| 1021 | ENMAR | 2 |
| 1022 | NNMVR | 2 |
| 1023 | TGMKR | 2 |
| 1024 | TAMKR | 2 |
| 1025 | AHMNR | 2 |
| 1026 | QNMGR | 2 |
| 1027 | TNMVR | 2 |
| 1028 | NHMNR | 2 |
| 1029 | EHMTR | 2 |
| 1030 | GNMIR | 2 |
| 1031 | SGMRR | 2 |
| 1032 | NHMSR | 2 |
| 1033 | GGMRL | 2 |
| 1034 | SPMKV | 2 |
| 1035 | TNMRR | 2 |
| 1036 | GNMRE | 2 |
| 1037 | ENMMR | 2 |
| 1038 | THMER | 1 |
| 1039 | QKMRT | 1 |
| 1040 | GAMRR | 1 |
| 1041 | TPMEV | 1 |
| 1042 | GGMRE | 1 |
| 1043 | GDMDR | 1 |
| 1044 | GAMRA | 1 |
| 1045 | PNMSR | 1 |
| 1046 | EGMGR | 1 |
| 1047 | EGTHR | 1 |
| 1048 | QSMRE | 1 |
| 1049 | THMKG | 1 |
| 1050 | NNMGR | 1 |
| 1051 | GHMNS | 1 |
| 1052 | IDMKG | 1 |

TABLE 7-continued

ZF6 selection on C:T change at nt 5 of core motif in CBS.
Sequences reflect position 2 to 6.

| SEQ ID NO: | Sequence | Read # |
|---|---|---|
| 1053 | ESMTR | 1 |
| 1054 | SHMKI | 1 |
| 1055 | HNMMR | 1 |
| 184 | SNMVR | 1 |
| 1056 | TAMKV | 1 |
| 1057 | DSMKR | 1 |
| 1058 | SNMAR | 1 |
| 1059 | ESMGR | 1 |
| 1060 | EAMRR | 1 |
| 1061 | GNMVR | 1 |
| 1062 | ANMRR | 1 |
| 1063 | DGMKI | 1 |
| 1064 | SHMHR | 1 |
| 1065 | GAMKE | 1 |
| 1066 | ESMRE | 1 |
| 1067 | GSMLR | 1 |
| 1068 | THMEV | 1 |
| 1069 | TSMGR | 1 |
| 1070 | EAMSK | 1 |
| 1071 | NAMRQ | 1 |
| 1072 | EGMRT | 1 |
| 1073 | SHMQR | 1 |
| 1074 | NGMKR | 1 |
| 1075 | ESMKE | 1 |
| 1076 | ANMHR | 1 |
| 1077 | DHTKR | 1 |
| 1078 | NGMRE | 1 |
| 1079 | GSMRA | 1 |
| 1080 | EGMNQ | 1 |
| 1081 | GGMRM | 1 |
| 1082 | PNMKR | 1 |
| 1083 | NGMKI | 1 |
| 1084 | SNMLR | 1 |
| 1085 | SNMRR | 1 |
| 1086 | SHMTR | 1 |
| 1087 | TGMRR | 1 |

TABLE 7-continued

ZF6 selection on C:T change at nt 5 of core motif in CBS.
Sequences reflect position 2 to 6.

| SEQ ID NO: | Sequence | Read # |
|---|---|---|
| 1088 | SGMRI | 1 |
| 1089 | DNMGR | 1 |
| 183 | EGMTR | 1 |

TABLE 8

ZF6 selection on C:A change at nt 5 of core motif in CBS.
Sequences reflect position 2 to 6.

| SEQ ID NO: | Sequence | Read # |
|---|---|---|
| 965 | GNMGR | 873 |
| 968 | ESMRR | 784 |
| 964 | EGMRR | 772 |
| 967 | EGMAR | 672 |
| 970 | EGMHR | 648 |
| 994 | QNMVR | 597 |
| 980 | TNMLR | 556 |
| 998 | SGMKR | 486 |
| 975 | NGMTA | 479 |
| 979 | GSMRR | 453 |
| 1003 | QAMRE | 452 |
| 961 | ENMGR | 434 |
| 960 | SAMRR | 431 |
| 993 | NGMAR | 401 |
| 1079 | GSMRA | 390 |
| 996 | ENMER | 389 |
| 1007 | SNMGR | 378 |
| 1046 | EGMGR | 376 |
| 1017 | DNMAR | 368 |
| 1063 | DGMKI | 347 |
| 999 | ANMQR | 342 |
| 1040 | GAMRR | 322 |
| 973 | VNMRR | 297 |
| 997 | NSMRR | 295 |
| 1005 | ESMQR | 293 |

TABLE 8-continued

ZF6 selection on C:A change at nt 5 of core motif in CBS.
Sequences reflect position 2 to 6.

| SEQ ID NO: | Sequence | Read # |
|---|---|---|
| 1018 | SSMRR | 289 |
| 1087 | TGMRR | 289 |
| 1009 | ANMNR | 279 |
| 1044 | GAMRA | 275 |
| 183 | EGMTR | 273 |
| 126 | EHMNR | 265 |
| 1004 | GNMSR | 263 |
| 971 | TAMRR | 260 |
| 972 | TNMQR | 257 |
| 1010 | DNMMR | 253 |
| 976 | DGMRR | 241 |
| 1026 | QNMGR | 240 |
| 1082 | PNMKR | 228 |
| 1089 | DNMGR | 226 |
| 1090 | ETMRR | 225 |
| 1091 | DNMKI | 224 |
| 1014 | SSMKI | 224 |
| 995 | DNMRR | 221 |
| 1053 | ESMTR | 214 |
| 1042 | GGMRE | 214 |
| 984 | TNMGR | 211 |
| 1031 | SGMRR | 204 |
| 986 | GGMRR | 203 |
| 1022 | NNMVR | 201 |
| 1092 | TNMER | 197 |
| 1083 | NGMKI | 195 |
| 1021 | ENMAR | 194 |
| 1059 | ESMGR | 194 |
| 1019 | GNMMR | 193 |
| 1036 | GNMRE | 193 |
| 1002 | DNMVR | 187 |
| 1093 | TNMAR | 186 |
| 34 | EHMRR | 182 |
| 1066 | ESMRE | 181 |
| 1027 | TNMVR | 181 |

TABLE 8-continued

ZF6 selection on C:A change at nt 5 of core motif in CBS. Sequences reflect position 2 to 6.

| SEQ ID NO: | Sequence | Read # |
|---|---|---|
| 1015 | TSMRR | 175 |
| 988 | SGMVR | 173 |
| 1024 | TAMKR | 170 |
| 1030 | GNMIR | 169 |
| 985 | SSMAR | 163 |
| 991 | GSMKI | 159 |
| 1094 | EHMKQ | 149 |
| 982 | ENMLR | 149 |
| 1016 | DGMKR | 144 |
| 1012 | GNMAQ | 139 |
| 1095 | SGMQR | 138 |
| 1084 | SNMLR | 133 |
| 1061 | GNMVR | 130 |
| 1001 | ANMGR | 129 |
| 1096 | HNMRR | 129 |
| 1050 | NNMGR | 128 |
| 1081 | GGMRM | 127 |
| 1033 | GGMRL | 124 |
| 1097 | QNMER | 124 |
| 1057 | DSMKR | 122 |
| 1035 | TNMRR | 122 |
| 1008 | GAMRI | 115 |
| 1058 | SNMAR | 115 |
| 1056 | TAMKV | 114 |
| 1098 | VSMKR | 113 |
| 966 | NGMRI | 112 |
| 1099 | TNMMR | 110 |
| 1013 | EGMKG | 109 |
| 1071 | NAMRQ | 108 |
| 123 | EHMKR | 107 |
| 1032 | NHMSR | 106 |
| 1100 | GAMRM | 102 |
| 1070 | EAMSK | 100 |
| 1101 | TAMNQ | 99 |

TABLE 8-continued

ZF6 selection on C:A change at nt 5 of core motif in CBS. Sequences reflect position 2 to 6.

| SEQ ID NO: | Sequence | Read # |
|---|---|---|
| 1102 | ESMSR | 96 |
| 1103 | GGMNQ | 95 |
| 1048 | QSMRE | 95 |
| 185 | NAMRG | 92 |
| 1104 | GGMKR | 89 |
| 184 | SNMVR | 84 |
| 1105 | ESMRL | 83 |
| 1075 | ESMKE | 81 |
| 1106 | SAMRE | 80 |
| 1107 | GGMQM | 76 |
| 1023 | TGMKR | 73 |
| 1037 | ENMMR | 69 |
| 1108 | NSMKM | 69 |
| 1109 | ESMKN | 66 |
| 1072 | EGMRT | 64 |
| 987 | GGMKL | 64 |
| 1110 | TNMSR | 63 |
| 1111 | DAMRV | 61 |
| 1112 | GNMER | 60 |
| 1113 | GAMRE | 59 |
| 182 | GNMAR | 54 |
| 1114 | EGMRK | 53 |
| 1011 | GSMKM | 50 |
| 1115 | SGMAR | 50 |

TABLE 9

ZF6 selection on C:G change at nt 5 of core motif in CBS. Sequences reflect position 2 to 6.

| SEQ ID NO: | Sequence | # Read |
|---|---|---|
| 34 | EHMRR | 3207 |
| 955 | GHMRR | 2397 |
| 957 | THMRR | 2025 |
| 956 | GHMNR | 1880 |

TABLE 9-continued

ZF6 selection on C:G change at nt 5 of core motif in CBS.
Sequences reflect position 2 to 6.

| SEQ ID NO: | Sequence | # Read |
|---|---|---|
| 33 | THMKR | 1415 |
| 35 | THMNR | 1341 |
| 958 | GHMKR | 1208 |
| 978 | EHMSR | 1038 |
| 127 | EHMAR | 927 |
| 962 | SHMKR | 771 |
| 959 | EHMQR | 764 |
| 126 | EHMNR | 676 |
| 146 | SHMNR | 646 |
| 147 | SHMRR | 579 |
| 123 | EHMKR | 511 |
| 1029 | EHMTR | 460 |
| 963 | NHMRR | 436 |
| 992 | EKMKE | 381 |
| 32 | DHMNR | 374 |
| 981 | NHMKR | 342 |
| 983 | SPMGV | 322 |
| 977 | GHMTR | 318 |
| 1028 | NHMNR | 285 |
| 1116 | DHMKR | 264 |
| 969 | GHMSR | 258 |
| 1025 | AHMNR | 247 |
| 989 | EHMHR | 232 |
| 974 | AHMKR | 227 |
| 31 | EHMGR | 210 |
| 1117 | GHMHR | 129 |
| 1118 | THMKV | 129 |
| 1020 | THMKL | 117 |
| 1006 | TPMKV | 110 |
| 1000 | GHMQR | 105 |
| 1119 | DHMRR | 105 |
| 990 | THMSR | 97 |
| 1120 | AHMRR | 92 |
| 1121 | EKMRE | 86 |
| 1122 | GHMAR | 84 |
| 1074 | NGMKR | 81 |
| 1123 | VHMNR | 77 |
| 1052 | IDMKG | 72 |
| 1124 | NHMTR | 65 |
| 1032 | NHMSR | 64 |
| 964 | EGMRR | 57 |
| 1125 | THMTR | 57 |
| 1126 | GHMKI | 56 |
| 1073 | SHMQR | 52 |
| 1127 | EHMVR | 43 |
| 1086 | SHMTR | 43 |
| 1128 | TKMKE | 42 |
| 1129 | EHMER | 38 |
| 1130 | THMKT | 37 |
| 1043 | GDMDR | 36 |
| 1131 | NGMRR | 35 |
| 1132 | EPMLM | 34 |
| 1133 | GHMVR | 31 |
| 1134 | THMRT | 29 |
| 968 | ESMRR | 28 |
| 1135 | PHMKR | 26 |
| 1136 | EHMRQ | 24 |
| 1137 | EHMRT | 23 |
| 1138 | DHMSR | 22 |
| 1039 | QKMRT | 22 |
| 1139 | ETMMI | 21 |
| 1034 | SPMKV | 21 |
| 1140 | SHMKL | 21 |
| 1141 | TPMKL | 21 |
| 1142 | GHMKM | 20 |
| 965 | GNMGR | 19 |
| 1143 | RQMLI | 19 |
| 1144 | GHMRM | 18 |
| 1145 | EGMKR | 17 |
| 1146 | EHMKA | 17 |
| 1147 | QIMPL | 17 |
| 1148 | SHMKV | 16 |

TABLE 9-continued

ZF6 selection on C:G change at nt 5 of core motif in CBS.
Sequences reflect position 2 to 6.

| SEQ ID NO: | Sequence | # Read |
|---|---|---|
| 1149 | SGMNR | 16 |
| 1150 | THMAR | 16 |
| 1151 | QGMKR | 15 |
| 960 | SAMRR | 14 |
| 1152 | TKMEG | 14 |
| 1153 | RPMGR | 14 |
| 1154 | VHMRR | 13 |
| 1155 | THMRV | 13 |
| 1068 | THMEV | 12 |
| 1156 | NHMKS | 11 |
| 1049 | THMKG | 11 |
| 1157 | AAMST | 11 |
| 980 | TNMLR | 11 |
| 996 | ENMER | 10 |
| 1158 | GKMRD | 10 |
| 1159 | THMEL | 10 |
| 998 | SGMKR | 10 |
| 1160 | TPMRV | 10 |
| 1161 | SPMRV | 10 |
| 1104 | GGMKR | 10 |
| 967 | EGMAR | 10 |
| 1162 | THMGV | 9 |
| 971 | TAMRR | 9 |
| 995 | DNMRR | 9 |
| 966 | NGMRI | 9 |
| 961 | ENMGR | 9 |
| 1163 | MGMGR | 8 |
| 973 | VNMRR | 8 |
| 1164 | GKPSM | 8 |
| 975 | NGMTA | 8 |
| 1165 | SHMRV | 8 |
| 1166 | SPMNR | 8 |
| 1167 | SAMNR | 8 |
| 1168 | SHMSR | 8 |
| 1169 | NGMPR | 8 |
| 972 | TNMQR | 8 |
| 1170 | SPMRR | 8 |
| 994 | QNMVR | 8 |
| 970 | EGMHR | 8 |
| 1017 | DNMAR | 7 |
| 1026 | QNMGR | 7 |
| 1171 | GHMGV | 7 |
| 1172 | THMRL | 7 |
| 979 | GSMRR | 7 |
| 1173 | QHMKR | 7 |
| 1174 | THMGR | 7 |
| 976 | DGMRR | 7 |
| 1175 | THMQR | 6 |
| 1038 | THMER | 6 |
| 1021 | ENMAR | 6 |
| 1176 | RHMKR | 6 |
| 1018 | SSMRR | 6 |
| 1177 | EHMRV | 6 |
| 1178 | KHMKR | 6 |
| 1179 | QHMNR | 6 |
| 1180 | RAMKV | 6 |
| 993 | NGMAR | 6 |
| 984 | TNMGR | 6 |
| 1002 | DNMVR | 6 |
| 1066 | ESMRE | 6 |
| 1181 | GHMRV | 6 |
| 982 | ENMLR | 6 |
| 185 | NAMRG | 5 |
| 1014 | SSMKI | 5 |
| 1182 | TPMGV | 5 |
| 1040 | GAMRR | 5 |
| 1183 | GHMKV | 5 |
| 1184 | RHMNR | 5 |
| 1009 | ANMNR | 5 |
| 1185 | TPMEL | 5 |
| 1022 | NNMVR | 5 |
| 988 | SGMVR | 5 |

TABLE 9-continued

ZF6 selection on C:G change at nt 5 of core motif in CBS.
Sequences reflect position 2 to 6.

| SEQ ID NO: | Sequence | # Read |
|---|---|---|
| 1186 | SPMKL | 5 |
| 1187 | SPMKR | 5 |
| 1035 | TNMRR | 5 |
| 1082 | PNMKR | 5 |
| 1188 | LAMEE | 5 |
| 1044 | GAMRA | 5 |
| 1100 | GAMRM | 5 |
| 1046 | EGMGR | 5 |
| 1033 | GGMRL | 5 |
| 1189 | PGMMS | 5 |
| 986 | GGMRR | 5 |
| 991 | GSMKI | 5 |
| 1089 | DNMGR | 5 |
| 183 | EGMTR | 4 |
| 1190 | SHMEV | 4 |
| 1004 | GNMSR | 4 |
| 1191 | GMMLT | 4 |
| 1003 | QAMRE | 4 |
| 997 | NSMRR | 4 |
| 1087 | TGMRR | 4 |
| 1192 | TPMKG | 4 |
| 1041 | TPMEV | 4 |
| 1193 | THMHR | 4 |
| 1194 | SHMGV | 4 |
| 1063 | DGMKI | 4 |
| 1016 | DGMKR | 4 |
| 1195 | THMKS | 4 |
| 1196 | THMRG | 4 |
| 1197 | GHMKT | 4 |
| 1015 | TSMRR | 4 |
| 1019 | GNMMR | 4 |
| 999 | ANMQR | 4 |
| 1079 | GSMRA | 4 |
| 1036 | GNMRE | 4 |
| 1083 | NGMKI | 4 |
| 1008 | GAMRI | 4 |
| 1050 | NNMGR | 4 |
| 1198 | THMRS | 4 |
| 1013 | EGMKG | 4 |
| 1199 | NHMQR | 4 |
| 1007 | SNMGR | 4 |
| 1200 | SHMAR | 3 |
| 1061 | GNMVR | 3 |
| 1201 | EAMKR | 3 |
| 1202 | GSMRE | 3 |
| 1203 | SPMEL | 3 |
| 1204 | AHMAR | 3 |
| 1057 | DSMKR | 3 |
| 1205 | PPMMV | 3 |
| 1027 | TNMVR | 3 |
| 1096 | HNMRR | 3 |
| 1206 | KHMNR | 3 |
| 1030 | GNMIR | 3 |
| 1084 | SNMLR | 3 |
| 1207 | TPMKR | 3 |
| 1208 | QSMKR | 3 |
| 1209 | RHMRR | 3 |
| 1075 | ESMKE | 3 |
| 1210 | DHMQR | 3 |
| 1056 | TAMKV | 3 |
| 1211 | AHMSR | 3 |
| 1212 | EHMRS | 3 |
| 1213 | AHMTR | 3 |
| 1214 | GHINR | 3 |
| 1048 | QSMRE | 3 |
| 1093 | TNMAR | 3 |
| 1215 | EYMRR | 3 |
| 1216 | GQMNR | 3 |
| 1217 | GHMKE | 3 |
| 1011 | GSMKM | 3 |
| 1064 | SHMHR | 3 |
| 1059 | ESMGR | 3 |

TABLE 9-continued

ZF6 selection on C:G change at nt 5 of core motif in CBS.
Sequences reflect position 2 to 6.

| SEQ ID NO: | Sequence | # Read |
|---|---|---|
| 1005 | ESMQR | 3 |
| 1051 | GHMNS | 3 |
| 1058 | SNMAR | 3 |
| 1012 | GNMAQ | 3 |
| 1023 | TGMKR | 3 |
| 1031 | SGMRR | 3 |
| 1001 | ANMGR | 3 |
| 987 | GGMKL | 3 |
| 1218 | EHMMR | 2 |
| 1219 | SHMRL | 2 |
| 1072 | EGMRT | 2 |
| 1107 | GGMQM | 2 |
| 1220 | GGMKA | 2 |
| 1070 | EAMSK | 2 |
| 1221 | EHMPR | 2 |
| 1222 | AHMKS | 2 |
| 1223 | AHMQR | 2 |
| 1224 | GHTRR | 2 |
| 1225 | GHMKG | 2 |
| 1226 | EPMKV | 2 |
| 1227 | EHMAK | 2 |
| 1228 | GYMNR | 2 |
| 1229 | THMSS | 2 |
| 1230 | GDMNR | 2 |
| 1231 | GHMRT | 2 |
| 1094 | EHMKQ | 2 |
| 1232 | QRMGV | 2 |
| 1233 | GSMRQ | 2 |
| 1234 | DHMTR | 2 |
| 1235 | VEMER | 2 |
| 1236 | SPMEV | 2 |
| 1237 | GPMKV | 2 |
| 1238 | TPMER | 2 |
| 1239 | EHMDR | 2 |
| 1240 | EHVRR | 2 |
| 1091 | DNMKI | 2 |
| 1241 | GGMAR | 2 |
| 1242 | HHMKR | 2 |
| 1243 | GHMRS | 2 |
| 1244 | EYMAR | 2 |
| 1245 | KHMRR | 2 |
| 1246 | EHMSS | 2 |
| 1247 | TPMRL | 2 |
| 1248 | GHMSL | 2 |
| 1249 | VHMKR | 2 |
| 1250 | GHTNR | 2 |
| 1251 | GPMRT | 2 |
| 1081 | GGMRM | 2 |
| 1092 | TNMER | 2 |
| 1109 | ESMKN | 2 |
| 1252 | EQMRR | 2 |
| 1053 | ESMTR | 2 |
| 1253 | EHMKS | 2 |
| 1254 | THMKM | 2 |
| 1065 | GAMKE | 2 |
| 1024 | TAMKR | 2 |
| 1010 | DNMMR | 2 |
| 985 | SSMAR | 2 |
| 1037 | ENMMR | 2 |
| 1255 | GTMKM | 1 |
| 1256 | VHRIR | 1 |
| 1257 | DHMNK | 1 |
| 1258 | TPMNM | 1 |
| 1259 | RQMII | 1 |
| 1260 | EHMRW | 1 |
| 1261 | SPMRL | 1 |
| 1262 | GVMRA | 1 |
| 1263 | GHMQV | 1 |
| 1264 | GPMKL | 1 |
| 1265 | IDMKR | 1 |
| 1266 | PGMMG | 1 |
| 1267 | KHMER | 1 |

TABLE 9-continued

ZF6 selection on C:G change at nt 5 of core motif in CBS.
Sequences reflect position 2 to 6.

| SEQ ID NO: | Sequence | # Read |
|---|---|---|
| 1268 | TPMNV | 1 |
| 1269 | EHVQR | 1 |
| 1270 | ENMKE | 1 |
| 1271 | DHMKM | 1 |
| 1272 | SHMNQ | 1 |
| 1108 | NSMKM | 1 |
| 1273 | GLMKR | 1 |
| 1274 | APMNL | 1 |
| 1275 | RHMSR | 1 |
| 1276 | EHMRG | 1 |
| 1277 | DWMRR | 1 |
| 1278 | GHMRH | 1 |
| 1279 | QNMHR | 1 |
| 1280 | CHMRR | 1 |
| 1281 | ERMRR | 1 |
| 1282 | EHMKE | 1 |
| 1283 | EPMKR | 1 |
| 1284 | AHINR | 1 |
| 1285 | SHMRT | 1 |
| 1286 | PHMNR | 1 |
| 1287 | AHMKV | 1 |
| 1288 | THMGM | 1 |
| 1289 | NGMKM | 1 |
| 1290 | EKMKR | 1 |
| 1291 | EHMIR | 1 |
| 1292 | NNMHR | 1 |
| 1293 | GNMNR | 1 |
| 1294 | KRMQR | 1 |
| 1295 | EKMRR | 1 |
| 1296 | TQMKQ | 1 |
| 1297 | EHMKV | 1 |
| 1298 | DHMKE | 1 |
| 1299 | EHTTR | 1 |
| 1300 | SPMRM | 1 |
| 1301 | GKMNR | 1 |
| 1302 | TNMKR | 1 |
| 1303 | THKRR | 1 |
| 1304 | SQTNR | 1 |
| 1305 | THLKR | 1 |
| 1306 | SHMQS | 1 |
| 1307 | THMSV | 1 |
| 1308 | THMRH | 1 |
| 1309 | DPMKV | 1 |
| 1310 | PHMMS | 1 |
| 1311 | SHVKR | 1 |
| 1102 | ESMSR | 1 |
| 1312 | SHMGL | 1 |
| 1313 | TDMVA | 1 |
| 1314 | PQMMS | 1 |
| 1315 | KHMQR | 1 |
| 1316 | EHMQL | 1 |
| 1317 | EHISR | 1 |
| 1318 | SHMKK | 1 |
| 1319 | EQMTR | 1 |
| 1320 | TPMRG | 1 |
| 1321 | GHISR | 1 |
| 1322 | GPMGV | 1 |
| 1323 | GYMRR | 1 |
| 1324 | GHMTV | 1 |
| 1325 | APMIM | 1 |
| 1326 | THINR | 1 |
| 1327 | DHMMS | 1 |
| 1328 | GHMKL | 1 |
| 1329 | EKMEE | 1 |
| 1330 | DPMRM | 1 |
| 1331 | SHMKT | 1 |
| 1332 | SPMGL | 1 |
| 1333 | SPMGE | 1 |
| 1334 | DHISR | 1 |
| 1335 | TPMKQ | 1 |
| 1336 | GHMKW | 1 |
| 1337 | EHMCR | 1 |

TABLE 9-continued

ZF6 selection on C:G change at nt 5 of core motif in CBS.
Sequences reflect position 2 to 6.

| SEQ ID NO: | Sequence | # Read |
| --- | --- | --- |
| 1338 | NNMKR | 1 |
| 1339 | ESMKR | 1 |
| 1340 | TEMLI | 1 |
| 1341 | SHMKM | 1 |
| 1342 | EHVNR | 1 |
| 1343 | GHMER | 1 |
| 1344 | NHMDR | 1 |
| 1345 | GHMWR | 1 |
| 1346 | THMKI | 1 |
| 1347 | QKMKE | 1 |
| 1348 | THMNK | 1 |
| 1349 | AHMKQ | 1 |
| 1350 | DHMGR | 1 |
| 1351 | EGMKW | 1 |
| 1352 | TQMKE | 1 |
| 1353 | TRMRR | 1 |
| 1354 | AHMGR | 1 |
| 1355 | TRMKR | 1 |
| 1356 | KNLTR | 1 |
| 1357 | PEMMS | 1 |
| 1358 | EHLTL | 1 |
| 1359 | RHMKV | 1 |
| 1360 | PGMIR | 1 |
| 1361 | THTKR | 1 |
| 1362 | EHIRR | 1 |
| 1363 | THMPR | 1 |
| 1364 | GKMKQ | 1 |
| 1365 | GPMRV | 1 |
| 1366 | AHVNR | 1 |
| 1367 | EPMSR | 1 |
| 1368 | PRMMV | 1 |
| 1369 | ELMSR | 1 |
| 1090 | ETMRR | 1 |
| 1370 | SNMNR | 1 |
| 1371 | TSMKT | 1 |
| 1372 | GNMHR | 1 |
| 1373 | TQMRR | 1 |
| 1374 | SHMKG | 1 |
| 1375 | DHMRT | 1 |
| 1376 | EHMRE | 1 |
| 1377 | SQLNR | 1 |
| 1378 | SHMGR | 1 |
| 1379 | GHKNR | 1 |
| 1380 | THMNL | 1 |
| 1381 | GYMKR | 1 |
| 1382 | SNMKV | 1 |
| 1383 | GHMRC | 1 |
| 1384 | NHMRV | 1 |
| 1385 | SGMKT | 1 |
| 1386 | EHLRR | 1 |
| 1387 | VPMRR | 1 |
| 1388 | DLMKR | 1 |
| 1389 | TSMKL | 1 |
| 1390 | APMTV | 1 |
| 1105 | ESMRL | 1 |
| 1391 | EHMLM | 1 |
| 1392 | EKMNR | 1 |
| 1393 | THRRR | 1 |
| 1111 | DAMRV | 1 |
| 1394 | ERMNR | 1 |
| 1395 | NHMHR | 1 |
| 1396 | DLMNR | 1 |
| 1397 | GQMQR | 1 |
| 1398 | RGMMI | 1 |
| 1399 | TQMKR | 1 |
| 1400 | EHMGV | 1 |
| 1401 | AHMTQ | 1 |
| 1402 | TPMMV | 1 |
| 1403 | GHKRR | 1 |
| 1404 | GPMER | 1 |
| 1405 | EPMQV | 1 |
| 1101 | TAMNQ | 1 |

TABLE 9-continued

ZF6 selection on C:G change at nt 5 of core motif in CBS.
Sequences reflect position 2 to 6.

| SEQ ID NO: | Sequence | # Read |
|---|---|---|
| 1406 | GDMRR | 1 |
| 1407 | EHLKR | 1 |
| 1408 | DHMKK | 1 |
| 1409 | GDIDR | 1 |
| 1410 | GHMKK | 1 |
| 1411 | TQMMI | 1 |
| 1412 | SGMKA | 1 |
| 1413 | TPMRM | 1 |
| 1414 | SPMKG | 1 |
| 1415 | KQLNR | 1 |
| 1416 | NHMKT | 1 |
| 1417 | TKMRE | 1 |
| 1098 | VSMKR | 1 |
| 1418 | EHMAV | 1 |
| 1419 | EHMNS | 1 |
| 1420 | DHMHR | 1 |
| 1421 | AHMVR | 1 |
| 1422 | GRMRR | 1 |
| 1423 | GHMNV | 1 |
| 1424 | GHMNL | 1 |
| 1425 | GHVSR | 1 |
| 1426 | GQMHR | 1 |
| 1427 | EKMAR | 1 |
| 1428 | NHMGL | 1 |
| 1429 | EHMKG | 1 |
| 1430 | EPMAL | 1 |
| 1431 | AHLTR | 1 |
| 1432 | KHMTR | 1 |
| 1433 | GHMTM | 1 |
| 1434 | EPMSG | 1 |
| 1435 | NHMNM | 1 |
| 1436 | GQMKR | 1 |
| 1437 | TPMEG | 1 |
| 1438 | KHMRV | 1 |
| 1439 | SLMKR | 1 |
| 1440 | DGMRN | 1 |
| 1441 | RQMHI | 1 |
| 1442 | EPMRV | 1 |
| 1113 | GAMRE | 1 |
| 1443 | SHMRM | 1 |
| 1444 | EQMAR | 1 |
| 1445 | SHMRS | 1 |
| 1446 | EHMQV | 1 |
| 1447 | EPMPM | 1 |
| 1448 | IDMNR | 1 |
| 1449 | TKMKQ | 1 |
| 1450 | RQMLS | 1 |
| 1451 | ATMML | 1 |
| 1452 | PQMMI | 1 |
| 1453 | NAMKI | 1 |
| 1454 | GHMQS | 1 |
| 1455 | EAMKK | 1 |
| 1456 | THMRK | 1 |
| 1457 | PHMRR | 1 |
| 1458 | GHMKA | 1 |
| 1459 | AHMNH | 1 |
| 1460 | EYMSR | 1 |
| 1461 | EHMAW | 1 |
| 1462 | NHMGR | 1 |
| 1463 | GHMKS | 1 |
| 1464 | EHMRL | 1 |
| 1465 | ENMTR | 1 |
| 1099 | TNMMR | 1 |
| 1466 | QAMRV | 1 |
| 1467 | EHMQP | 1 |
| 1468 | THMSM | 1 |
| 1469 | IDMKE | 1 |
| 1047 | EGTHR | 1 |
| 1055 | HNMMR | 1 |
| 1045 | PNMSR | 1 |
| 184 | SNMVR | 1 |
| 1062 | ANMRR | 1 |

TABLE 9-continued

ZF6 selection on C:G change at nt 5 of core motif in CBS.
Sequences reflect position 2 to 6.

| SEQ ID NO: | Sequence | # Read |
|---|---|---|
| 1042 | GGMRE | 1 |
| 1060 | EAMRR | 1 |
| 1067 | GSMLR | 1 |
| 1054 | SHMKI | 1 |
| 1076 | ANMHR | 1 |
| 1069 | TSMGR | 1 |
| 1077 | DHTKR | 1 |
| 1078 | NGMRE | 1 |
| 1071 | NAMRQ | 1 |
| 1080 | EGMNQ | 1 |
| 1085 | SNMRR | 1 |
| 1088 | SGMRI | 1 |

TABLE 10

ZF6 selection on A:C change at nt 6 of core motif in CBS.
Sequences reflect position -1 to 3.

| SEQ ID NO: | Sequence | Read # |
|---|---|---|
| 37 | HRES | 6362 |
| 36 | MNES | 5959 |
| 1470 | VKES | 3337 |
| 1471 | LRDS | 2986 |
| 1472 | HLES | 1799 |
| 1473 | TRES | 1285 |
| 1474 | MREA | 648 |
| 1475 | VRET | 601 |
| 1476 | MRET | 284 |
| 1477 | LLES | 222 |
| 1478 | MRTS | 192 |
| 1479 | ERKS | 122 |
| 1480 | IKES | 111 |
| 38 | RPDT | 95 |
| 1481 | VRVT | 61 |
| 1482 | RNES | 51 |
| 1483 | HVES | 41 |
| 98 | RTET | 40 |
| 1484 | LSHT | 33 |
| 1485 | RPES | 33 |
| 1486 | SRES | 32 |
| 1487 | ENKA | 25 |
| 167 | RADN | 24 |
| 1488 | TREN | 23 |
| 1489 | DSPQ | 21 |
| 1490 | RRES | 20 |
| 1491 | RGEN | 17 |
| 1492 | VRES | 17 |
| 1493 | HRDS | 15 |
| 1494 | HREA | 15 |
| 1495 | LRDT | 15 |
| 1496 | RVES | 15 |
| 1497 | EKKS | 14 |
| 1498 | GRES | 13 |
| 1499 | RMES | 13 |
| 1500 | LRES | 12 |
| 1501 | RTDN | 12 |
| 1502 | HADH | 12 |
| 1503 | VNES | 12 |
| 1504 | ANES | 12 |
| 112 | RTEN | 12 |
| 1505 | RNEH | 11 |
| 1506 | MNET | 11 |
| 1507 | RLDT | 11 |
| 99 | RADV | 10 |
| 1508 | RLET | 9 |
| 1509 | HRET HMR... | 9 9 |
| 1510 | NRES | 8 |
| 1511 | TGEA | 8 |
| 1512 | TGES | 8 |
| 1513 | RHET | 8 |
| 1514 | MRES | 7 |
| 172 | RNDT | 7 |

TABLE 10-continued

ZF6 selection on A:C change at nt 6 of core motif in CBS.
Sequences reflect position −1 to 3.

| SEQ ID NO: | Sequence | Read # |
|---|---|---|
| 1515 | LVES | 7 |
| 1516 | VGSS | 7 |
| 40 | RHDT | 7 |
| 1517 | RIDT | 7 |
| 1518 | VREA | 6 |
| 1519 | HMES | 6 |
| 1520 | ERKN | 5 |
| 1521 | RPEA | 5 |
| 1522 | TPPI | 5 |
| 1523 | RREA | 5 |
| 1524 | RQEN | 5 |
| 1525 | VKDS | 4 |
| 1526 | RKES | 4 |
| 1527 | MLGL... | 4 |
| 1528 | DRPN | 4 |
| 1529 | RKEA | 4 |
| 1530 | VMLGL... | 4 |
| 1531 | TRDS | 4 |
| 1532 | HLET | 4 |
| 1533 | HLDS | 4 |
| 1534 | PPAT | 4 |
| 1535 | ENAS | 4 |
| 1536 | VKET | 4 |
| 1537 | GREA | 4 |
| 1538 | TREA H... | 4 4 |
| 1539 | IRDS | 3 |
| 1540 | MNDS | 3 |
| 1541 | LLDS | 3 |
| 1542 | RTES | 3 |
| 1543 | RPET | 3 |
| 1544 | IDVH | 3 |
| 1545 | RTEH | 3 |
| 1546 | TRET | 3 |
| 1547 | HGES | 3 |
| 1548 | TMES | 3 |
| 1549 | LRVS | 2 |
| 1550 | PREA | 2 |
| 1551 | EGKN | 2 |
| 1552 | TSES | 2 |
| 1553 | VKFGHIFCVL L*NV... | 2 |
| 1554 | YRES | 2 |
| 1555 | MKES | 2 |
| 39 | RTDI | 2 |
| 1556 | MNEG | 2 |
| 1557 | MIES | 2 |
| 1558 | QRES | 2 |
| 1559 | MMEA | 2 |
| 1560 | MNER RGS | 2 2 |
| 171 | RTSS | 2 |
| 1561 | RNAS | 2 |
| 1562 | RTDT | 2 |
| 1563 | TRVS | 1 |
| 1564 | TFNV | 1 |
| 1565 | VRVS | 1 |
| 1566 | FRDS | 1 |
| 1567 | IKER | 1 |
| 1568 | RLEN | 1 |
| 1569 | IKET | 1 |
| 1570 | HRVS | 1 |
| 1571 | DRKG | 1 |
| 1572 | VKEC | 1 |
| 1573 | MSEA | 1 |
| 1574 | LRDR | 1 |
| 1575 | INES | 1 |
| 1576 | MSES | 1 |
| 1577 | NLES | 1 |
| 1578 | LQDS | 1 |
| 1579 | HAPT HRR... | 1 1 |
| 1580 | HRKA | 1 |
| 1581 | LRGS | 1 |

TABLE 10-continued

ZF6 selection on A:C change at nt 6 of core motif in CBS.
Sequences reflect position -1 to 3.

| SEQ ID NO: | Sequence | Read # |
|---|---|---|
| 1582 | QSGT | 1 |
| 1583 | HQES | 1 |
| 1584 | ETGS | 1 |
|  | SGT... | 1 |
| 1585 | MLGF... | 1 |
| 1586 | MNGS | 1 |
| 1587 | MRED | 1 |
| 1588 | TKES | 1 |
| 1589 | RPDH | 1 |
| 1590 | HRGS | 1 |
| 1591 | GNES | 1 |
| 1592 | LWDS | 1 |
| 1593 | MRDS | 1 |
| 1594 | IHES | 1 |
| 1595 | LRDG | 1 |
| 1596 | LRDC | 1 |
| 1597 | MYES | 1 |
| 1598 | RPNI | 1 |
| 1599 | EGRS | 1 |
|  | TRR... | 1 |
| 1600 | RLES | 1 |
| 1601 | LGLPTGR... | 1 |
| 1602 | ARES | 1 |
| 1603 | HLGS | 1 |
| 1604 | HSES | 1 |
| 1605 | PRTS | 1 |
| 1606 | MNKS | 1 |
| 1607 | RRDS | 1 |
| 1608 | RREN | 1 |
| 1609 | QGES | 1 |
| 1610 | LREA | 1 |
| 1611 | LLET | 1 |
| 1612 | MREV | 1 |
| 1613 | VEES | 1 |
| 1614 | MNEA | 1 |
| 1615 | RNEN | 1 |
| 1616 | HWES | 1 |
| 1617 | RHEA | 1 |
| 1618 | MTES | 1 |
| 1619 | GRDS | 1 |
| 1620 | VSET | 1 |
| 1621 | MRKA | 1 |
| 1622 | FKES | 1 |
| 1623 | ERKG | 1 |
|  | VKR... | 1 |
| 1624 | RNDH | 1 |
| 1625 | VPDA | 1 |
|  | TGR... | 1 |
| 1626 | RKDA | 1 |
| 1627 | SPDT | 1 |
| 1628 | TTTL | 1 |
| 1629 | RKDS | 1 |
| 1630 | RRLT | 1 |
| 1631 | RTSN | 1 |
|  | LRT... | 1 |
| 1632 | RQSA | 1 |
| 1633 | ARFT | 1 |
| 1634 | DRKS | 1 |
| 169 | RRDT | 1 |
| 1635 | RMDS | 1 |
| 1636 | HRKS | 1 |
| 1637 | GTTP | 1 |
| 1638 | DKRN | 1 |
| 1639 | RPERE... | 1 |
| 1640 | SGDS | 1 |
|  | TAG | 1 |
|  | GR... | 1 |
|  | T... | 1 |
| 1582 | ...QSGT... | 0 |

TABLE 11

ZF6 selection on A:G change at nt 6 of core motif in CBS.
Sequences reflect position −1 to 3.

| SEQ ID NO: | Sequence | # Reads |
|---|---|---|
| 38 | RPDT | 6216 |
| 1482 | RNES | 2750 |
| 98 | RTET | 1736 |
| 1485 | RPES | 1565 |
| 167 | RADN | 1412 |
| 112 | RTEN | 973 |
| 1499 | RMES | 860 |
| 1507 | RLDT | 734 |
| 1490 | RRES | 690 |
| 1501 | RTDN | 588 |
| 1496 | RVES | 584 |
| 1505 | RNEH | 575 |
| 1517 | RIDT | 557 |
| 1521 | RPEA | 516 |
| 1491 | RGEN | 467 |
| 99 | RADV | 455 |
| 172 | RNDT | 452 |
| 1513 | RHET | 413 |
| 1529 | RKEA | 340 |
| 1508 | RLET | 297 |
| 1543 | RPET | 263 |
| 1523 | RREA | 252 |
| 40 | RHDT | 247 |
| 37 | HRES | 239 |
| 1526 | RKES | 231 |
| 1524 | RQEN | 199 |
| 1641 | RGSA | 186 |
| 171 | RTSS | 154 |
| 39 | RTDI | 152 |
| 1479 | ERKS | 123 |
| 36 | MNES | 104 |
| 1561 | RNAS | 90 |
| 1608 | RREN | 88 |
| 1642 | RLDP | 82 |
| 169 | RRDT | 80 |
| 1545 | RTEH | 80 |

TABLE 11-continued

ZF6 selection on A:G change at nt 6 of core motif in CBS.
Sequences reflect position −1 to 3.

| SEQ ID NO: | Sequence | # Reads |
|---|---|---|
| 1626 | RKDA | 63 |
| 1470 | VKES | 61 |
| 1643 | RRET | 53 |
| 1471 | LRDS | 44 |
| 1562 | RTDT | 36 |
| 1568 | RLEN | 35 |
| 1564 | TFNV | 29 |
| 1644 | RADT | 28 |
| 1472 | HLES | 28 |
| 1473 | TRES | 27 |
| 1645 | RKET | 24 |
| 1646 | ATNM | 23 |
| 1647 | RREH | 22 |
| 1648 | RTDH | 21 |
| 1632 | RQSA | 21 |
| 1542 | RTES | 20 |
| 1649 | RNET | 20 |
| 1650 | RPDN | 19 |
| 1651 | THVP | 19 |
| 1633 | ARFT | 18 |
| 1487 | ENKA | 18 |
| 1637 | GTTP | 17 |
| 1652 | EASN | 16 |
| 1653 | RMEG | 14 |
| 1654 | RTAA | 14 |
| 1589 | RPDH | 14 |
| 1627 | SPDT | 14 |
| 1489 | DSPQ | 14 |
| 1497 | EKKS | 13 |
| 1474 | MREA | 13 |
| 1655 | RNEP | 12 |
| 1656 | VHDN | 12 |
| 1657 | RKEN | 12 |
| 1658 | RPYT | 12 |
| 1659 | RQES | 11 |
| 1660 | RSGS | 11 |

TABLE 11-continued

ZF6 selection on A:G change at nt 6 of core motif in CBS.
Sequences reflect position −1 to 3.

| SEQ ID NO: | Sequence | # Reads |
|---|---|---|
| 1661 | RPDS | 10 |
| 1475 | VRET | 10 |
| 1662 | MTGN | 7 |
| 1530 | VMLGL... | 7 |
| 1615 | RNEN | 7 |
| 1663 | RGET | 6 |
| 1664 | RKGS | 6 |
| 1600 | RLES | 5 |
| 1476 | MRET | 5 |
| 1624 | RNDH | 5 |
| 1665 | RNDS | 5 |
| 1666 | STET | 5 |
| 1537 | GREA | 5 |
| 1667 | SNES | 5 |
| 1668 | RPDA | 4 |
| 1669 | RNER | 4 |
| 1670 | RPEN | 4 |
| 1671 | RVET | 4 |
| 1672 | RAET | 4 |
| 1673 | SHET | 4 |
| 1674 | RSDTQ... | 4 |
| 1535 | ENAS | 3 |
| 1675 | LPDT | 3 |
| 1676 | MMES | 3 |
| 1677 | SPES | 3 |
| 1678 | RMEN | 3 |
| 1679 | RVEI | 3 |
| 1607 | RRDS | 3 |
| 1680 | RMET | 3 |
| 1681 | SADN | 3 |
| 1682 | RAES | 3 |
| 1683 | RPDV | 3 |
| 1684 | RTEA | 3 |
| 1685 | RHES | 3 |
| 1686 | RQEA | 3 |
| 1478 | MRTS | 3 |
| 1520 | ERKN | 3 |
| 1687 | RNRS | 2 |
| 1688 | RAEA | 2 |
| 1689 | RVDN | 2 |
| 1690 | RNEG | 2 |
| 1691 | RVEG | 2 |
| 1692 | RAEN | 2 |
| 1693 | RVDT | 2 |
| 1694 | RDDN | 2 |
| 1695 | RLEA | 2 |
| 1696 | RPNT | 2 |
| 1697 | RGES | 2 |
| 1698 | SPEA | 2 |
| 1699 | RTAG | 2 |
| 1700 | MKEA | 2 |
| 1486 | SRES | 2 |
| 1701 | WNES | 2 |
| 1591 | GNES | 2 |
| 1629 | RKDS | 2 |
| 1628 | TTTL | 2 |
| 1702 | RVEN | 2 |
| 1635 | RMDS | 2 |
| 1703 | RMEH | 2 |
| 1630 | RRLT | 2 |
| 1704 | RKEH | 1 |
| 1705 | ENRS | 1 |
| 1706 | RNKS | 1 |
| 1707 | RPGE... | 1 |
| 1708 | RKDT | 1 |
| 1625 | VPDA | 1 |
| 1709 | RGEA | 1 |
| 1710 | WIDT | 1 |
| 1711 | RNEY | 1 |
| 1712 | RADI | 1 |
| 1713 | RADY | 1 |
| 1714 | RTDD | 1 |

TABLE 11-continued

ZF6 selection on A:G change at nt 6 of core motif in CBS.
Sequences reflect position −1 to 3.

| SEQ ID NO: | Sequence | # Reads |
|---|---|---|
| 1715 | RVDS | 1 |
| 1716 | HTET | 1 |
| 1717 | HTEN | 1 |
| 1718 | SGEN | 1 |
| 1719 | RTST | 1 |
| 1720 | RAGR... | 1 |
| 1721 | SNAS | 1 |
| 1722 | RPGT | 1 |
| 1723 | RAEH | 1 |
| 1724 | MHDT | 1 |
| 1725 | REDN | 1 |
| 1726 | REEV | 1 |
|  | RRR... | 1 |
| 1727 | RMEW | 1 |
| 1728 | RRER | 1 |
| 1729 | RLDN | 1 |
|  | RPT... | 1 |
| 1730 | MVES | 1 |
| 1510 | NRES | 1 |
| 1731 | RIPA | 1 |
| 1732 | RMEA | 1 |
| 1733 | RHNT | 1 |
| 1734 | RNSS | 1 |
| 1735 | LPES | 1 |
| 1736 | SLDP | 1 |
| 1737 | STEN | 1 |
| 1738 | RPKS | 1 |
|  | ATS... | 1 |
| 1739 | MIDT | 1 |
| 1740 | PPDT | 1 |
| 1741 | GLDA | 1 |
| 1742 | RPEGE... | 1 |
| 1743 | RHYT | 1 |
| 1744 | RTEI | 1 |
| 1745 | SPEN | 1 |
|  | APR... | 1 |
|  | LSL... | 1 |
| 1746 | RHEN | 1 |
| 1747 | REDV | 1 |
| 1748 | RLKT | 1 |
| 1749 | RIET | 1 |
| 1750 | RIES | 1 |
| 1477 | LLES | 1 |
| 1751 | RPDI | 1 |
| 1752 | MNDT | 1 |
| 1753 | RLYT | 1 |
| 1504 | ANES | 1 |
| 1754 | RAYN | 1 |
| 1755 | RADS | 1 |
| 1756 | KNES | 1 |
| 1757 | RVSA | 1 |
| 1758 | RPED | 1 |
| 1759 | RGEH | 1 |
| 1728 | RRER... | 1 |
| 1760 | LTET | 1 |
| 1761 | LADN | 1 |
|  | GTR... | 1 |
| 1762 | RPER... | 1 |
| 1763 | MLGLPGTR... | 1 |
| 1764 | RPDP | 1 |
| 1765 | QADV | 1 |
| 1599 | EGRS | 1 |
|  | RGR... | 1 |
| 1766 | MADV | 1 |
| 1767 | HTDN | 1 |
| 1768 | RKEV | 1 |
| 1769 | RADA | 1 |
| 1770 | RDAS | 1 |
| 1771 | MLDT | 1 |
| 1772 | RPGS | 1 |
| 1773 | RTEY | 1 |
| 1774 | SLDT | 1 |
| 1775 | RWES | 1 |
| 1776 | ERKA | 1 |
| 1777 | RIYT | 1 |

TABLE 11-continued

ZF6 selection on A:G change at nt 6 of core motif in CBS.
Sequences reflect position -1 to 3.

| SEQ ID NO: | Sequence | # Reads |
|---|---|---|
| 1778 | TPVP | 1 |
| 1779 | RQDA | 1 |
| 1780 | RMER | 1 |
| 1631 | RTSN | 1 |
|  | LRT... | 1 |
| 1559 | MMEA | 1 |
| 1481 | VRVT | 1 |
| 1634 | DRKS | 1 |
| 1488 | TREN | 1 |
| 1636 | HRKS | 1 |
| 1500 | LRES | 1 |
| 1639 | RPERE... | 1 |
| 1638 | DKRN | 1 |
| 1781 | VGTV | 1 |
| 1582 | ...QSGT... | 0 |

TABLE 12

ZF6 selection on A:C change at nt 6 of core motif in CBS.
Sequences reflect position -1 to 3.

| SEQ ID NO: | Sequence | # Reads |
|---|---|---|
| 37 | HRES | 7487 |
| 1479 | ERKS | 7125 |
| 1489 | DSPQ | 876 |
| 1487 | ENKA | 801 |
| 1497 | EKKS | 508 |
| 1473 | TRES | 141 |
| 38 | RPDT | 126 |
| 1520 | ERKN | 120 |
| 1537 | GREA | 112 |
| 1535 | ENAS | 103 |
| 1471 | LRDS | 95 |
| 36 | MNES | 89 |
| 1504 | ANES | 84 |
| 1571 | DRKG | 73 |
| 1634 | DRKS | 72 |

TABLE 12-continued

ZF6 selection on A:C change at nt 6 of core motif in CBS.
Sequences reflect position -1 to 3.

| SEQ ID NO: | Sequence | # Reads |
|---|---|---|
| 1599 | EGRS | 69 |
| 1584 | ETGS | 67 |
| 1482 | RNES | 60 |
| 1470 | VKES | 57 |
| 1486 | SRES | 50 |
| 98 | RTET | 42 |
| 1625 | VPDA | 39 |
| 1630 | RRLT | 37 |
| 167 | RADN | 30 |
| 1485 | RPES | 30 |
| 1782 | ERGG | 27 |
| 1472 | HLES | 25 |
| 1638 | DKRN | 25 |
| 112 | RTEN | 21 |
| 1628 | TTTL | 19 |
| 1636 | HRKS | 19 |
| 1490 | RRES | 19 |
| 1499 | RMES | 18 |
| 1551 | EGKN | 17 |
| 1623 | ERKG | 16 |
| 1491 | RGEN | 16 |
| 1705 | ENRS | 15 |
| 1498 | GRES | 15 |
| 1501 | RTDN | 15 |
| 1507 | RLDT | 13 |
| 1496 | RVES | 13 |
| 1517 | RIDT | 13 |
| 1510 | NRES | 13 |
| 1505 | RNEH | 12 |
| 1783 | EKGT | 11 |
| 1513 | RHET | 11 |
| 1474 | MREA | 10 |
| 1543 | RPET | 9 |
|  | QGK | 9 |
| 1519 | HMES | 9 |
| 1475 | VRET | 9 |

TABLE 12-continued

ZF6 selection on A:C change at nt 6 of core motif in CBS.
Sequences reflect position -1 to 3.

| SEQ ID NO: | Sequence | # Reads |
|---|---|---|
| 99 | RADV HMR... | 9 9 |
| 1784 | ERNS | 8 |
| 1524 | RQEN | 8 |
| 172 | RNDT | 8 |
| 40 | RHDT | 8 |
| 1493 | HRDS | 7 |
| 171 | RTSS | 7 |
| 1529 | RKEA | 7 |
| 1785 | ENNS | 6 |
| 1776 | ERKA | 6 |
| 1523 | RREA RGS QEK... | 5 5 5 |
| 1478 | MRTS | 5 |
| 1500 | LRES | 4 |
| 1526 | RKES | 4 |
| 1786 | HREN | 4 |
| 1521 | RPEA | 4 |
| 1547 | HGES | 4 |
| 39 | RTDI | 4 |
| 1508 | RLET | 4 |
| 1477 | LLES | 3 |
| 1626 | RKDA | 3 |
| 1476 | MRET | 3 |
| 1590 | HRGS | 3 |
| 1787 | ERKR | 3 |
| 1561 | RNAS | 3 |
| 1788 | ERKI | 3 |
| 1789 | ERRS | 2 |
| 1642 | RLDP | 2 |
| 1604 | HSES | 2 |
| 1790 | YSPQ | 2 |
| 1791 | EGKS | 2 |
| 1792 | HRER QVK... | 2 2 |
| 1793 | DRKA | 2 |

TABLE 12-continued

ZF6 selection on A:C change at nt 6 of core motif in CBS.
Sequences reflect position -1 to 3.

| SEQ ID NO: | Sequence | # Reads |
|---|---|---|
| 1794 | ESGN QG... | 2 2 |
| 1795 | ERES | 2 |
| 1796 | HKES | 2 |
| 1797 | ESKS | 2 |
| 1558 | QRES | 2 |
| 1798 | EMKS | 2 |
| 1627 | SPDT | 2 |
| 169 | RRDT | 2 |
| 1527 | MLGL... | 2 |
| 1633 | ARFT | 2 |
| 1562 | RTDT | 2 |
| 1799 | KRKS | 1 |
| 1652 | EASN | 1 |
| 1800 | TGDA | 1 |
| 1801 | NRKS RGK | 1 1 |
| 1802 | EKNS HRE... | 1 1 |
| 1803 | QGKS | 1 |
| 1662 | MTGN | 1 |
| 1804 | DSTQ TGE... | 1 1 |
| 1805 | VRKS | 1 |
| 1509 | HRET | 1 |
| 1806 | ENKV | 1 |
| 1568 | RLEN | 1 |
| 1732 | RMEA | 1 |
| 1494 | HREA | 1 |
| 1692 | RAEN | 1 |
| 1774 | SLDT R... | 1 1 |
| 1512 | TGES | 1 |
| 1644 | RADT QAK... | 1 1 |
| 1807 | DIPQ QGT... | 1 1 |
| 1808 | ERKC | 1 |
| 1809 | HSPQ | 1 |

TABLE 12-continued

ZF6 selection on A:C change at nt 6 of core motif in CBS.
Sequences reflect position -1 to 3.

| SEQ ID NO: | Sequence | # Reads |
|---|---|---|
| 1542 | RTES | 1 |
| 1538 | TREA | 1 |
| 1810 | RTAT | 1 |
|  | QGR... | 1 |
| 1811 | TRKS | 1 |
| 1812 | GRKS | 1 |
| 1813 | ESKA | 1 |
|  | ERK... | 1 |
| 1554 | YRES | 1 |
| 1814 | EKRN | 1 |
|  | MGK... | 1 |
| 1815 | DSPH | 1 |
| 1816 | ERNG | 1 |
| 1817 | VSPQ | 1 |
|  | QWK... | 1 |
| 1818 | EKKC | 1 |
| 1601 | LGLPTGR... | 1 |
| 1819 | ERNN | 1 |
| 1643 | RRET | 1 |
| 1820 | TNES | 1 |
| 1821 | HRKN | 1 |
|  | RLF... | 1 |
| 1822 | DKSN | 1 |
| 1823 | DRNS | 1 |
|  | KRN | 1 |
| 1824 | ERMS | 1 |
| 1608 | RREN | 1 |
| 1825 | EIAS | 1 |
| 1826 | HREC | 1 |
| 1827 | ERKT | 1 |
| 1828 | ETGN | 1 |
| 1632 | RQSA | 1 |
| 1631 | RTSN | 1 |
| 1635 | RMDS | 1 |
| 1545 | RTEH | 1 |
| 1559 | MMEA | 1 |
| 1629 | RKDS | 1 |
|  | LRT... | 1 |
| 1481 | VRVT | 1 |
| 1488 | TREN | 1 |

TABLE 12-continued

ZF6 selection on A:C change at nt 6 of core motif in CBS.
Sequences reflect position -1 to 3.

| SEQ ID NO: | Sequence | # Reads |
|---|---|---|
| 1639 | RPERE... | 1 |
| 1637 | GTTP | 1 |
| 1640 | SGDS | 1 |
| 1582 | ...QSGT... | 0 |

TABLE 13

ZF5 selection on G:T change at nt 7 of core motif in CBS.
Sequences reflect position 2 to 6.

| SEQ ID NO: | Sequence | # Read |
|---|---|---|
| 165 | TRLKE | 2129 |
| 42 | HRLKE | 1938 |
| 44 | SRLKE | 1530 |
| 110 | TRLRE | 1078 |
| 1829 | HRLRE | 1073 |
| 47 | NRLKE | 1015 |
| 1830 | QRLRE | 769 |
| 1831 | DALKR | 700 |
| 109 | DGLKR | 681 |
| 1832 | SRLRE | 534 |
| 43 | HALKV | 389 |
| 94 | NRLKV | 381 |
| 93 | ERLRV | 375 |
| 1833 | DGLKK | 374 |
| 41 | HGLKV | 335 |
| 1834 | HRLKV | 315 |
| 1835 | ERLRM | 295 |
| 1836 | QRLKE | 243 |
| 1837 | DGLVR | 235 |
| 46 | HTLKV | 233 |
| 1838 | NRLRE | 195 |
| 1839 | ARLRE | 168 |
| 108 | DALRR | 168 |
| 1840 | ERLRQ | 141 |
| 1841 | ARLKE | 135 |

TABLE 13-continued

ZF5 selection on G:T change at nt 7 of core motif in CBS.
Sequences reflect position 2 to 6.

| SEQ ID NO: | Sequence | # Read |
|---|---|---|
| 1842 | TRLRD | 125 |
| 1843 | DGLRR | 118 |
| 1844 | SRLNE | 118 |
| 1845 | TGLKV | 92 |
| 1846 | HRLSE | 91 |
| 1847 | HRLNE | 78 |
| 1848 | SHLKV | 75 |
| 1849 | TTLKV | 75 |
| 1850 | HRLGE | 68 |
| 1851 | STLKV | 66 |
| 1852 | DGLKV | 65 |
| 1853 | DGLRK | 61 |
| 1854 | HRLTE | 60 |
| 1855 | DRLKV | 59 |
| 1856 | HSLKV | 56 |
| 45 | DGLRV | 47 |
| 1857 | SRLKV | 45 |
| 1858 | QRLKV | 44 |
| 1859 | HGLTV | 43 |
| 1860 | HRLME | 43 |
| 1861 | RLLPN | 42 |
| 1862 | ERLKV | 41 |
| 1863 | NRLRV | 35 |
| 1864 | TRLKV | 34 |
| 1865 | DGLKE | 29 |
| 454 | DTLKV | 29 |
| 1866 | HGLRV | 29 |
| 1867 | SALKT | 28 |
| 1868 | HRLAE | 25 |
| 1869 | ERLIS | 23 |
| 1870 | DGLTR | 22 |
| 1871 | DALVR | 21 |
| 1872 | HRLKR | 21 |
| 1873 | ERLRE | 20 |
| 1874 | HQLKV | 20 |
| 1875 | TTLKQ | 18 |

TABLE 13-continued

ZF5 selection on G:T change at nt 7 of core motif in CBS.
Sequences reflect position 2 to 6.

| SEQ ID NO: | Sequence | # Read |
|---|---|---|
| 1876 | SRLKR | 17 |
| 1877 | DRLKQ | 16 |
| 1878 | HRLRV | 16 |
| 1879 | TRLKR | 16 |
| 1880 | TRLNE | 16 |
| 1881 | NRLKQ | 15 |
| 1882 | TRLKD | 14 |
| 1883 | TRLRV | 14 |
| 1884 | EALKR | 13 |
| 1885 | HTLKQ | 13 |
| 1886 | NALKV | 13 |
| 1887 | SALKV | 13 |
| 1888 | SRLKD | 13 |
| 1889 | DGLRE | 12 |
| 1890 | ERLKE | 12 |
| 488 | DTLKQ | 11 |
| 1891 | HKLKV | 11 |
| 1892 | GTLKV | 10 |
| 1893 | ERLRR | 9 |
| 1894 | HALKT | 9 |
| 1895 | HGLKE | 9 |
| 1896 | HHLVQ | 9 |
| 1897 | NGLKV | 9 |
| 538 | DALKE | 8 |
| 1898 | DALKV | 8 |
| 1899 | HALKE | 8 |
| 1900 | HHLKQ | 8 |
| 1901 | HHLKV | 8 |
| 1902 | TRLKK | 8 |
| 1903 | DRLRT | 7 |
| 1904 | DRLRV | 7 |
| 371 | DTLRV | 7 |
| 1905 | HRLKK | 7 |
| 262 | HTLKE | 7 |
| 1906 | NRLKK | 7 |
| 235 | STLKE | 7 |

TABLE 13-continued

ZF5 selection on G:T change at nt 7 of core motif in CBS.
Sequences reflect position 2 to 6.

| SEQ ID NO: | Sequence | # Read |
|---|---|---|
| 1907 | SRLIE | 6 |
| 1908 | TRLME | 6 |
| 1909 | ATLKV | 5 |
| 1910 | HGLVV | 5 |
| 1911 | HRLRM | 5 |
| 1912 | HRLRQ | 5 |
| 1913 | HTLKA | 5 |
| 1914 | NRLRD | 5 |
| 1915 | TGLKE | 5 |
| 1916 | TGLKT | 5 |
| 1917 | TRLRQ | 5 |
| 1918 | TTLKI | 5 |
| 1919 | TTLRV | 5 |
| 1920 | DRLKE | 4 |
| 1921 | HRLKA | 4 |
| 1922 | HRLKD | 4 |
| 1923 | HSLKE | 4 |
| 1924 | NRLKI | 4 |
| 1925 | NRLKR | 4 |
| 1926 | STLKA | 4 |
| 548 | STLKQ | 4 |
| 1927 | TRLKA | 4 |
| 1928 | TRLKQ | 4 |
| 1929 | TRLRR | 4 |
| 447 | DTLKA | 3 |
| 1930 | HALKR | 3 |
| 1931 | HGLKA | 3 |
| 1932 | HGLKR | 3 |
| 1933 | HPEG... | 3 |
| 1934 | HRLK... | 3 |
| 1935 | HRLRK | 3 |
| 1936 | HTLRV | 3 |
| 1937 | NTLKQ | 3 |
| 1938 | QRLRV | 3 |
| 1939 | SRLME | 3 |
| 1940 | SRPKE | 3 |
| 1941 | TQLKV | 3 |
| 1942 | TRLQE | 3 |
| 1943 | TRLR... | 3 |
| 1944 | ARLKR | 2 |
| 1945 | ARLKV | 2 |
| 1946 | ARLR... | 2 |
| 1947 | ARLRV | 2 |
| 1948 | ARLVR | 2 |
| 1949 | DALKK | 2 |
| 1950 | DALRV | 2 |
| 1951 | DAPKR | 2 |
| 1952 | DRLRE | 2 |
| 1953 | EGLKV | 2 |
| 1954 | ERLLV | 2 |
| 1955 | ERLRA | 2 |
| 1956 | ERMRM | 2 |
| 1957 | GGLKV | 2 |
| 1958 | GGLVT | 2 |
| 1959 | HALRE | 2 |
| 1960 | HGLRE | 2 |
| 1961 | HHLKE | 2 |
| 1962 | HILKA | 2 |
| 1963 | HRLQE | 2 |
| 1964 | HRLRR | 2 |
| 1965 | KRLKE | 2 |
| 1966 | KTLKQ | 2 |
| 1967 | NALKE | 2 |
| 1968 | NRLNE | 2 |
| 1969 | NTLKV | 2 |
| 1970 | QRLKR | 2 |
| 1971 | QRLRQ | 2 |
| 1972 | QSLIA | 2 |
| 1973 | QTLKV | 2 |
| 1974 | RKLRS | 2 |
| 1975 | RRLRE | 2 |
| 1976 | SALKE | 2 |

TABLE 13-continued

ZF5 selection on G:T change at nt 7 of core motif in CBS.
Sequences reflect position 2 to 6.

| SEQ ID NO: | Sequence | # Read |
|---|---|---|
| 1977 | SRLKK | 2 |
| 1978 | SRLRK | 2 |
| 1979 | SRLRV | 2 |
| 297 | STLRV | 2 |
| 1980 | TMLKE | 2 |
| 1981 | TRLKG | 2 |
| 1982 | TRLRM | 2 |
| 1983 | TRLTE | 2 |
| 1984 | TRRKE | 2 |
| 1985 | AALKR | 1 |
| 1986 | AGLKR | 1 |
| 1987 | AGLKV | 1 |
| 1988 | AGLVR | 1 |
| 1989 | ARLGE | 1 |
| 1990 | ARLME | 1 |
| 1991 | ARLNE | 1 |
| 1992 | ARLRD | 1 |
| 1993 | ARLRM | 1 |
| 1994 | CRLKE | 1 |
| 1995 | DALDR | 1 |
| 1996 | DALKT | 1 |
| 1997 | DALKW | 1 |
| 1998 | DALRK | 1 |
| 1999 | DALTV | 1 |
| 2000 | DELKR | 1 |
| 2001 | DELPG | 1 |
| 2002 | DGLK... | 1 |
| 2003 | DGLKG | 1 |
| 2004 | DGLKW | 1 |
| 2005 | DGLLR | 1 |
| 2006 | DGLRQ | 1 |
| 2007 | DGLTV | 1 |
| 2008 | DGLVW | 1 |
| 1016 | DGMKR | 1 |
| 2009 | DKLKQ | 1 |
| 2010 | DKLRQ | 1 |
| 2011 | DRLRK | 1 |
| 2012 | DTHAG... | 1 |
| 2013 | DTLKT | 1 |
| 2014 | DVLKK | 1 |
| 2015 | EAAG... | 1 |
| 2016 | EHLRQ | 1 |
| 2017 | ELLKV | 1 |
| 2018 | EPLRV | 1 |
| 2019 | ERLCV | 1 |
| 2020 | ERLKK | 1 |
| 1893 | ERLRR... | 1 |
| 2021 | ERLVR | 1 |
| 2022 | ERLWE | 1 |
| 2023 | ERPRM | 1 |
| 2024 | ERPRV | 1 |
| 2025 | ERQRM | 1 |
| 2026 | GGLKQ | 1 |
| 2027 | GGLKR | 1 |
| 2028 | GMLKV | 1 |
| 2029 | GRLKE | 1 |
| 2030 | GTLKQ | 1 |
| 2031 | HALKA | 1 |
| 2032 | HALKG | 1 |
| 2033 | HALPV | 1 |
| 2034 | HAPEV | 1 |
| 2035 | HGLKK | 1 |
| 2036 | HGLKQ | 1 |
| 2037 | HGLMV | 1 |
| 2038 | HGLPV | 1 |
| 2039 | HGLRD | 1 |
| 54 | HGLVR | 1 |
| 2040 | HGQKE | 1 |
| 2041 | HGRKV | 1 |
| 2042 | HGRRG | 1 |
| 2043 | HHLRV | 1 |
| 2044 | HILIA | 1 |

TABLE 13-continued

ZF5 selection on G:T change at nt 7 of core motif in CBS.
Sequences reflect position 2 to 6.

| SEQ ID NO: | Sequence | # Read |
|---|---|---|
| 2045 | HKLKE | 1 |
| 2046 | HKLRV | 1 |
| 2047 | HMLKR | 1 |
| 2048 | HMLRE | 1 |
| 2049 | HNLKV | 1 |
| 2050 | HPLKV | 1 |
| 2051 | HQLKE | 1 |
| 2052 | HQLRE | 1 |
| 2053 | HQLRV | 1 |
|  | HR*A... | 1 |
| 2054 | HRGCG... | 1 |
| 2055 | HRLDE | 1 |
| 2056 | HRLIE | 1 |
| 2057 | HRLKF | 1 |
| 2058 | HRLKG | 1 |
| 2059 | HRLKL | 1 |
| 2060 | HRLMV | 1 |
| 2061 | HRLN... | 1 |
| 2062 | HRLR... | 1 |
| 2063 | HRLRA | 1 |
| 2064 | HRLS... | 1 |
| 2065 | HRLVR | 1 |
| 2066 | HRMRE | 1 |
| 2067 | HRPKE | 1 |
| 2068 | HRPNE | 1 |
| 2069 | HRQRE | 1 |
| 2070 | HRRKE | 1 |
| 2071 | HRRME | 1 |
| 2072 | HRRRE | 1 |
| 2073 | HRVRE | 1 |
| 2074 | HSACG... | 1 |
| 2075 | HSLNV | 1 |
| 2076 | HSLRV | 1 |
| 2077 | HTLAQ | 1 |
| 2078 | HTLNV | 1 |
| 2079 | HTMKV | 1 |
| 2080 | HVLKV | 1 |
| 2081 | HWLRE | 1 |
| 2082 | KGLKQ | 1 |
| 2083 | MHLRS | 1 |
| 2084 | MRLRE | 1 |
| 2085 | MRLRM | 1 |
| 2086 | NALKR | 1 |
| 2087 | NGLKE | 1 |
| 2088 | NLLRE | 1 |
| 2089 | NMLKE | 1 |
| 2090 | NMLNV | 1 |
| 2091 | NPLRE | 1 |
| 2092 | NRFKE | 1 |
| 2093 | NRLIE | 1 |
| 2094 | NRLKA | 1 |
| 2095 | NRLKF | 1 |
| 2096 | NRLKL | 1 |
| 2097 | NRLKT | 1 |
| 2098 | NRLME | 1 |
| 2099 | NRLND | 1 |
| 2100 | NRLNV | 1 |
| 2101 | NRLQE | 1 |
| 2102 | NRLR... | 1 |
| 2103 | NRLRM | 1 |
| 2104 | NRLRQ | 1 |
| 2105 | NRMKE | 1 |
| 2106 | NRPKE | 1 |
| 2107 | NRPKV | 1 |
| 2108 | NRQKE | 1 |
| 2109 | NSLKE | 1 |
| 2110 | NTLTV | 1 |
| 2111 | PRLKE | 1 |
| 2112 | PRLLP | 1 |
| 2113 | PRLRE | 1 |
| 2114 | PRLTE | 1 |
| 2115 | QAEG... | 1 |
| 2116 | QRLIS | 1 |

TABLE 13-continued

ZF5 selection on G:T change at nt 7 of core motif in CBS. Sequences reflect position 2 to 6.

| SEQ ID NO: | Sequence | # Read |
|---|---|---|
| 2117 | QRLKK | 1 |
| 2118 | QRLME | 1 |
| 2119 | QRLRG | 1 |
| 2120 | QRLRM | 1 |
| 2121 | QRLTE | 1 |
| 2122 | QTA*R... | 1 |
| 2123 | QTAW... | 1 |
| 2124 | QTG*S...R... | 1 1 |
| 2125 | RGLKV | 1 |
| 2126 | RRLGD | 1 |
| 2127 | RRLKE | 1 |
| 2128 | RRLNE | 1 |
| 2129 | RRLTK | 1 |
| 2130 | SALKK | 1 |
| 2131 | SALKR | 1 |
| 2132 | SCLKE | 1 |
| 2133 | SGLAM | 1 |
| 2134 | SGLAV | 1 |
| 2135 | SGLKV | 1 |
| 2136 | SHLKE | 1 |
| 2137 | SKLKV | 1 |
| 649 | SNLKV | 1 |
| 2138 | SQLKV | 1 |
| 2139 | SRLIG | 1 |
| 2140 | SRLK... | 1 |
| 2141 | SRLKA | 1 |
| 2142 | SRLKG | 1 |
| 2143 | SRLQE | 1 |
| 2144 | SRLR... | 1 |
| 2145 | SRLRA | 1 |
| 2146 | SRLRM | 1 |
| 2147 | SRLRQ | 1 |
| 2148 | SRLTE | 1 |
| 2149 | SRQRE | 1 |
| 2150 | SSLKE | 1 |
| 2151 | SSLKV | 1 |
| 2152 | SSQRE | 1 |
| 2153 | STLKRTAG... | 1 1 |
| 2154 | TGLKG | 1 |
| 2155 | TGLKQ | 1 |
| 2156 | TGLKS | 1 |
| 2157 | TGLRV | 1 |
| 2158 | TGRRG | 1 |
| 2159 | TLLRE | 1 |
| 2160 | TMQKE | 1 |
| 2161 | TRL*L | 1 |
| 2162 | TRLAE | 1 |
| 2163 | TRLE... | 1 |
| 2164 | TRLEE | 1 |
| 2165 | TRLGE | 1 |
| 2166 | TRLK... | 1 |
| 2167 | TRLKY | 1 |
| 2168 | TRLRG | 1 |
| 2169 | TRLRK | 1 |
| 2170 | TRLSE | 1 |
| 2171 | TRPKE | 1 |
| 2172 | TRQRD | 1 |
| 2173 | TRRRD | 1 |
| 2174 | TRVRE | 1 |
| 2175 | TSLRE | 1 |
| 2176 | TTLKA | 1 |
| 2177 | TTLKE | 1 |
| 2178 | TTLKL | 1 |
| 2179 | TTLKT | 1 |
| 2180 | TTPRG | 1 |
| 2181 | TTRKQ | 1 |
| 2182 | TWLRE | 1 |
| 2183 | VRRKV | 1 |
| 2184 | YGLKR | 1 |

TABLE 13-continued

ZF5 selection on G:T change at nt 7 of core motif in CBS. Sequences reflect position 2 to 6.

| SEQ ID NO: | Sequence | # Read |
|---|---|---|
| 2185 | YRLKE | 1 |
| 2186 | YTLKV | 1 |

TABLE 14

ZF5 selection on G:C change at nt 7 of core motif in CBS. Sequences reflect position 2 to 6.

| SEQ ID NO: | Sequence | Read # |
|---|---|---|
| 44 | SRLKE | 2533 |
| 165 | TRLKE | 2146 |
| 42 | HRLKE | 1984 |
| 47 | NRLKE | 1528 |
| 1829 | HRLRE | 1001 |
| 1832 | SRLRE | 799 |
| 110 | TRLRE | 625 |
| 46 | HTLKV | 499 |
| 41 | HGLKV | 320 |
| 1830 | QRLRE | 299 |
| 1851 | STLKV | 249 |
| 1841 | ARLKE | 238 |
| 1836 | QRLKE | 135 |
| 235 | STLKE | 126 |
| 1849 | TTLKV | 102 |
| 447 | DTLKA | 95 |
| 1891 | HKLKV | 87 |
| 454 | DTLKV | 84 |
| 43 | HALKV | 82 |
| 1962 | HILKA | 80 |
| 1845 | TGLKV | 80 |
| 1839 | ARLRE | 78 |
| 1850 | HRLGE | 75 |
| 1838 | NRLRE | 75 |
| 1854 | HRLTE | 61 |
| 1861 | RLLPN | 55 |
| 1852 | DGLKV | 50 |

TABLE 14-continued

ZF5 selection on G:C change at nt 7 of core motif in CBS. Sequences reflect position 2 to 6.

| SEQ ID NO: | Sequence | Read # |
|---|---|---|
| 1834 | HRLKV | 46 |
| 1856 | HSLKV | 43 |
| 1931 | HGLKA | 37 |
| 94 | NRLKV | 30 |
| 1901 | HHLKV | 27 |
| 1972 | QSLIA | 26 |
| 371 | DTLRV | 25 |
| 1864 | TRLKV | 25 |
| 2177 | TTLKE | 25 |
| 262 | HTLKE | 24 |
| 1888 | SRLKD | 23 |
| 1948 | ARLVR | 20 |
| 2187 | SKLKE | 20 |
| 1855 | DRLKV | 19 |
| 93 | ERLRV | 19 |
| 1857 | SRLKV | 19 |
| 1831 | DALKR | 18 |
| 109 | DGLKR | 18 |
| 2029 | GRLKE | 18 |
| 1892 | GTLKV | 18 |
| 1842 | TRLRD | 17 |
| 1913 | HTLKA | 16 |
| 1868 | HRLAE | 15 |
| 488 | DTLKQ | 14 |
| 1895 | HGLKE | 14 |
| 2188 | HILKT | 14 |
| 1974 | RKLRS | 14 |
| 2133 | SGLAM | 12 |
| 1875 | TTLKQ | 12 |
| 1926 | STLKA | 11 |
| 1833 | DGLKK | 10 |
| 2126 | RRLGD | 10 |
| 1882 | TRLKD | 10 |
| 2189 | TSLKV | 10 |
| 1837 | DGLVR | 9 |
| 1835 | ERLRM | 9 |

TABLE 14-continued

ZF5 selection on G:C change at nt 7 of core motif in CBS.
Sequences reflect position 2 to 6.

| SEQ ID NO: | Sequence | Read # |
|---|---|---|
| 1961 | HHLKE | 9 |
| 1896 | HHLVQ | 9 |
| 1847 | HRLNE | 9 |
| 1885 | HTLKQ | 9 |
| 1880 | TRLNE | 9 |
| 2190 | HRLHE | 8 |
| 1848 | SHLKV | 8 |
| 2191 | SKLRM | 8 |
| 45 | DGLRV | 7 |
| 1862 | ERLKV | 7 |
| 2192 | GTLRV | 7 |
| 1921 | HRLKA | 7 |
| 2193 | HTLKS | 7 |
| 1844 | SRLNE | 7 |
| 1915 | TGLKE | 7 |
| 108 | DALRR | 6 |
| 2194 | HGLKT | 6 |
| 1859 | HGLTV | 6 |
| 2045 | HKLKE | 6 |
| 1860 | HRLME | 6 |
| 1887 | SALKV | 6 |
| 1909 | ATLKV | 5 |
| 2195 | DTLKE | 5 |
| 2196 | GILND | 5 |
| 2135 | SGLKV | 5 |
| 2141 | SRLKA | 5 |
| 1871 | DALVR | 4 |
| 2197 | ETLKV | 4 |
| 1846 | HRLSE | 4 |
| 1923 | HSLKE | 4 |
| 1936 | HTLRV | 4 |
| 1969 | NTLKV | 4 |
| 1858 | QRLKV | 4 |
| 2140 | SRLK... | 4 |
| 2198 | THLKE | 4 |
| 1928 | TRLKQ | 4 |
| 1945 | ARLKV | 3 |
| 1853 | DGLRK | 3 |
| 1843 | DGLRR | 3 |
| 1840 | ERLRQ | 3 |
| 1957 | GGLKV | 3 |
| 1960 | HGLRE | 3 |
| 1900 | HHLKQ | 3 |
| 1965 | KRLKE | 3 |
| 2199 | NALRV | 3 |
| 1897 | NGLKV | 3 |
| 2200 | NRLGE | 3 |
| 1906 | NRLKK | 3 |
| 1975 | RRLRE | 3 |
| 2132 | SCLKE | 3 |
| 2137 | SKLKV | 3 |
| 2201 | SRLRD | 3 |
| 1979 | SRLRV | 3 |
| 548 | STLKQ | 3 |
| 1927 | TRLKA | 3 |
| 1942 | TRLQE | 3 |
| 2186 | YTLKV | 3 |
| 2202 | APLLR | 2 |
| 2009 | DKLKQ | 2 |
| 2203 | DKLKV | 2 |
| 1920 | DRLKE | 2 |
| 1873 | ERLRE | 2 |
| 1899 | HALKE | 2 |
| 2043 | HHLRV | 2 |
| 2051 | HQLKE | 2 |
| 2204 | HRLEE | 2 |
| 1878 | HRLRV | 2 |
| 2205 | HTLKG | 2 |
| 1966 | KTLKQ | 2 |
| 2206 | MVLVV | 2 |
| 2094 | NRLKA | 2 |
| 2207 | NRLKD | 2 |

TABLE 14-continued

ZF5 selection on G:C change at nt 7 of core motif in CBS.
Sequences reflect position 2 to 6.

| SEQ ID NO: | Sequence | Read # |
|---|---|---|
| 1881 | NRLKQ | 2 |
| 2101 | NRLQE | 2 |
| 2108 | NRQKE | 2 |
| 2208 | NTLKA | 2 |
| 1938 | QRLRV | 2 |
| 1973 | QTLKV | 2 |
| 2127 | RRLKE | 2 |
| 2209 | SRLKQ | 2 |
| 2151 | SSLKV | 2 |
| 553 | STLRQ | 2 |
| 297 | STLRV | 2 |
| 1983 | TRLTE | 2 |
| 2175 | TSLRE | 2 |
| 1987 | AGLKV | 1 |
| 2210 | AQMKE | 1 |
| 1991 | ARLNE | 1 |
| 1992 | ARLRD | 1 |
| 2211 | ARRRE | 1 |
| 2212 | CRLM... | 1 |
| 2213 | CRLMV | 1 |
| 538 | DALKE | 1 |
| 1898 | DALKV | 1 |
| 2001 | DELPG | 1 |
| 1865 | DGLKE | 1 |
| 2010 | DKLRQ | 1 |
| 2214 | DRLKA | 1 |
| 2215 | DRLKT | 1 |
| 1952 | DRLRE | 1 |
| 1903 | DRLRT | 1 |
| 2013 | DTLKT | 1 |
| 2216 | DTPKA | 1 |
| 1869 | ERLIS | 1 |
| 1893 | ERLRR... | 1 |
| 2023 | ERPRM | 1 |
| 2026 | GGLKQ | 1 |
| 2028 | GMLKV | 1 |
| 2217 | GRLKA | 1 |
| 2218 | GRLKV | 1 |
| 2030 | GTLKQ | 1 |
| 2219 | GVLKE | 1 |
| 2220 | GVLTG | 1 |
| 2221 | HALDV | 1 |
| 2031 | HALKA | 1 |
| 2222 | HELKV | 1 |
| 2223 | HGLEA | 1 |
| 2036 | HGLKQ | 1 |
| 2224 | HGLRG | 1 |
| 2225 | HGMKA | 1 |
| 2226 | HGPKV | 1 |
| 2044 | HILIA | 1 |
| 2227 | HILKE | 1 |
| 2228 | HILKV | 1 |
| 2229 | HILNA | 1 |
| 2230 | HKLKG | 1 |
| 2231 | HKLKQ | 1 |
| 2046 | HKLRV | 1 |
| 2048 | HMLRE | 1 |
| 1933 | HPEG... | 1 |
| 2232 | HPLKE | 1 |
| 1874 | HQLKV | 1 |
| 2233 | HRLGV | 1 |
| 1922 | HRLKD | 1 |
| 2058 | HRLKG | 1 |
| 2059 | HRLKL | 1 |
| 1872 | HRLKR | 1 |
| 2234 | HRLLE | 1 |
| 2235 | HRLQG | 1 |
| 2063 | HRLRA | 1 |
| 2236 | HRLRS | 1 |
| 2237 | HRLTV | 1 |
| 2065 | HRLVR | 1 |
| 2066 | HRMRE | 1 |

TABLE 14-continued

ZF5 selection on G:C change at nt 7 of core motif in CBS.
Sequences reflect position 2 to 6.

| SEQ ID NO: | Sequence | Read # |
|---|---|---|
| 2072 | HRRRE | 1 |
| 2238 | HSG*G... | 1 |
| 2239 | HSLKQ | 1 |
| 2240 | HSLRE | 1 |
| 2241 | HSVKA | 1 |
| 2242 | HTG*R... | 1 |
| 2077 | HTLAQ | 1 |
| 2243 | HTLEV | 1 |
| 215 | HTLME | 1 |
| 2244 | HTLMV | 1 |
| 2245 | HTLQE | 1 |
| 2246 | HTLRQ | 1 |
| 2080 | HVLKV | 1 |
| 2247 | IRLKE | 1 |
| 2248 | IRQEE | 1 |
| 2082 | KGLKQ | 1 |
| 2249 | KRLKV | 1 |
| 2250 | LRLKK | 1 |
| 2251 | NKLKE | 1 |
| 2252 | NKLKG | 1 |
| 2092 | NRFKE | 1 |
| 2253 | NRLAE | 1 |
| 2254 | NRLEE | 1 |
| 1925 | NRLKR | 1 |
| 2255 | NRLKS | 1 |
| 2097 | NRLKT | 1 |
| 1914 | NRLRD | 1 |
| 2256 | NRLRG | 1 |
| 1863 | NRLRV | 1 |
| 2257 | NRLTE | 1 |
| 2109 | NSLKE | 1 |
| 1937 | NTLKQ | 1 |
| 2258 | PAEG... | 1 |
| 2259 | PPPPE | 1 |
| 2113 | PRLRE | 1 |
| 2115 | QAEG... | 1 |
| 2260 | QGRRE | 1 |
| 2261 | QRLEE | 1 |
| 2119 | QRLRG | 1 |
| 2262 | QSLGR | 1 |
| 2134 | SGLAV | 1 |
| 2263 | SKLK... | 1 |
| 2264 | SMLRE | 1 |
| 2265 | SRLAE | 1 |
| 2266 | SRLCE | 1 |
| 2142 | SRLKG | 1 |
| 2267 | SRLLE | 1 |
| 2143 | SRLQE | 1 |
| 2145 | SRLRA | 1 |
| 1978 | SRLRK | 1 |
| 1940 | SRPKE | 1 |
| 2149 | SRQRE | 1 |
| 2268 | SRRKE | 1 |
| 2150 | SSLKE | 1 |
| 2152 | SSQRE | 1 |
| 539 | STLRA | 1 |
| 202 | STLRE | 1 |
| 2155 | TGLKQ | 1 |
| 2269 | TGLRE | 1 |
| 2270 | THLKV | 1 |
| 2271 | TILYE | 1 |
| 2272 | TLLKE | 1 |
| 1981 | TRLKG | 1 |
| 1908 | TRLME | 1 |
| 1883 | TRLRV | 1 |
| 2273 | TRLTV | 1 |
| 2274 | TRMGE | 1 |
| 2275 | TRMKQ | 1 |
| 2176 | TTLKA | 1 |
| 1918 | TTLKI | 1 |
| 2178 | TTLKL | 1 |
| 2276 | YTLKE | 1 |

TABLE 15

ZF5 selection on G:A change at nt 7 of core motif in CBS. Sequences reflect position 2 to 6.

| SEQ ID NO: | Sequence | Read # |
|---|---|---|
| 46 | HTLKV | 3934 |
| 41 | HGLKV | 2682 |
| 1851 | STLKV | 2167 |
| 1861 | RLLPN | 1887 |
| 1849 | TTLKV | 1471 |
| 43 | HALKV | 923 |
| 454 | DTLKV | 888 |
| 1875 | TTLKQ | 754 |
| 1891 | HKLKV | 571 |
| 1885 | HTLKQ | 513 |
| 1845 | TGLKV | 482 |
| 1892 | GTLKV | 473 |
| 488 | DTLKQ | 462 |
| 1852 | DGLKV | 443 |
| 1856 | HSLKV | 352 |
| 1896 | HHLVQ | 298 |
| 1901 | HHLKV | 259 |
| 1834 | HRLKV | 210 |
| 42 | HRLKE | 190 |
| 371 | DTLRV | 189 |
| 44 | SRLKE | 186 |
| 165 | TRLKE | 178 |
| 1887 | SALKV | 177 |
| 1909 | ATLKV | 155 |
| 1900 | HHLKQ | 149 |
| 1926 | STLKA | 140 |
| 1897 | NGLKV | 136 |
| 47 | NRLKE | 124 |
| 548 | STLKQ | 118 |
| 1973 | QTLKV | 112 |
| 1874 | HQLKV | 94 |
| 2135 | SGLKV | 91 |
| 1829 | HRLRE | 89 |
| 1936 | HTLRV | 88 |
| 297 | STLRV | 78 |
| 447 | DTLKA | 75 |

TABLE 15-continued

ZF5 selection on G:A change at nt 7 of core motif in CBS. Sequences reflect position 2 to 6.

| SEQ ID NO: | Sequence | Read # |
|---|---|---|
| 1957 | GGLKV | 75 |
| 1928 | TRLKQ | 75 |
| 1966 | KTLKQ | 69 |
| 2277 | HTL*A | 66 |
| 1913 | HTLKA | 64 |
| 1832 | SRLRE | 61 |
| 110 | TRLRE | 58 |
| 1937 | NTLKQ | 56 |
| 2278 | SKLKQ | 55 |
| 1830 | QRLRE | 53 |
| 2203 | DKLKV | 51 |
| 1919 | TTLRV | 48 |
| 2151 | SSLKV | 43 |
| 1848 | SHLKV | 42 |
| 2030 | GTLKQ | 40 |
| 1864 | TRLKV | 40 |
| 2270 | THLKV | 38 |
| 1969 | NTLKV | 37 |
| 553 | STLRQ | 35 |
| 2279 | HALRV | 34 |
| 1931 | HGLKA | 33 |
| 2009 | DKLKQ | 32 |
| 109 | DGLKR | 29 |
| 1953 | EGLKV | 29 |
| 2197 | ETLKV | 29 |
| 2280 | GILKV | 28 |
| 1855 | DRLKV | 26 |
| 1866 | HGLRV | 24 |
| 2281 | SVLKQ | 23 |
| 1831 | DALKR | 22 |
| 93 | ERLRV | 22 |
| 2282 | GQLHV | 21 |
| 2283 | TTLRQ | 21 |
| 45 | DGLRV | 20 |
| 2284 | DTLKN | 20 |
| 2179 | TTLKT | 20 |

TABLE 15-continued

ZF5 selection on G:A change at nt 7 of core motif in CBS.
Sequences reflect position 2 to 6.

| SEQ ID NO: | Sequence | Read # |
|---|---|---|
| 2285 | GVLKV | 17 |
| 2010 | DKLRQ | 16 |
| 2286 | GTLKA | 16 |
| 2026 | GGLKQ | 15 |
| 2036 | HGLKQ | 15 |
| 2043 | HHLRV | 15 |
| 94 | NRLKV | 15 |
| 2192 | GTLRV | 14 |
| 262 | HTLKE | 14 |
| 2287 | SVLKV | 14 |
| 2155 | TGLKQ | 14 |
| 1835 | ERLRM | 13 |
| 1838 | NRLRE | 13 |
| 2137 | SKLKV | 13 |
| 649 | SNLKV | 13 |
| 2288 | TVLKV | 13 |
| 1841 | ARLKE | 12 |
| 1839 | ARLRE | 12 |
| 1833 | DGLKK | 12 |
| 2289 | HHLRQ | 12 |
| 2205 | HTLKG | 12 |
| 2080 | HVLKV | 12 |
| 1917 | TRLRQ | 12 |
| 2290 | NTLRQ | 11 |
| 2134 | SGLAV | 11 |
| 108 | DALRR | 10 |
| 2291 | QTLKQ | 10 |
| 2292 | RTLKQ | 10 |
| 235 | STLKE | 10 |
| 1987 | AGLKV | 9 |
| 2013 | DTLKT | 9 |
| 274 | HHLVV | 9 |
| 2049 | HNLKV | 9 |
| 1836 | QRLKE | 9 |
| 2293 | STLKG | 9 |
| 2294 | TVLKQ | 9 |
| 1837 | DGLVR | 8 |
| 2295 | GGLVV | 8 |
| 2296 | HGLQV | 8 |
| 1850 | HRLGE | 8 |
| 1854 | HRLTE | 8 |
| 2246 | HTLRQ | 8 |
| 1857 | SRLKV | 8 |
| 2297 | DTLKG | 7 |
| 2298 | GGLTV | 7 |
| 2299 | GVLKA | 7 |
| 2031 | HALKA | 7 |
| 2194 | HGLKT | 7 |
| 2176 | TTLKA | 7 |
| 2300 | GTLRQ | 6 |
| 2301 | HALKQ | 6 |
| 1844 | SRLNE | 6 |
| 2302 | STLKT | 6 |
| 1842 | TRLRD | 6 |
| 2303 | ATLKA | 5 |
| 2304 | ATLKQ | 5 |
| 2305 | DGLKQ | 5 |
| 1843 | DGLRR | 5 |
| 1862 | ERLKV | 5 |
| 2306 | GTLNA | 5 |
| 2307 | GVLKN | 5 |
| 1895 | HGLKE | 5 |
| 1910 | HGLVV | 5 |
| 2308 | TTLKG | 5 |
| 1853 | DGLRK | 4 |
| 1840 | ERLRQ | 4 |
| 2309 | ETLRV | 4 |
| 2310 | HGLKG | 4 |
| 2311 | HGLNV | 4 |
| 1859 | HGLTV | 4 |
| 1961 | HHLKE | 4 |
| 1846 | HRLSE | 4 |

TABLE 15-continued

ZF5 selection on G:A change at nt 7 of core motif in CBS.
Sequences reflect position 2 to 6.

| SEQ ID NO: | Sequence | Read # |
|---|---|---|
| 1886 | NALKV | 4 |
| 484 | STLTV | 4 |
| 2312 | VGLGE | 4 |
| 2186 | YTLKV | 4 |
| 2313 | AGLAT | 3 |
| 1948 | ARLVR | 3 |
| 2314 | D*LPG | 3 |
| 2003 | DGLKG | 3 |
| 2315 | DKLRV | 3 |
| 1899 | HALKE | 3 |
| 1860 | HRLME | 3 |
| 2239 | HSLKQ | 3 |
| 2078 | HTLNV | 3 |
| 2079 | HTMKV | 3 |
| 2316 | HTQKV | 3 |
| 2262 | QSLGR | 3 |
| 1974 | RKLRS | 3 |
| 474 | STLNV | 3 |
| 2177 | TTLKE | 3 |
| 1871 | DALVR | 2 |
| 2001 | DELPG | 2 |
| 2317 | DGLRA | 2 |
| 2318 | DVLKV | 2 |
| 2319 | GALRV | 2 |
| 2320 | GGLVQ | 2 |
| 2321 | GNLKV | 2 |
| 2322 | GPLKV | 2 |
| 2323 | GTLKG | 2 |
| 2324 | GVLKQ | 2 |
| 2325 | GVLRV | 2 |
| 678 | GVLVA | 2 |
| 2032 | HALKG | 2 |
| 2326 | HDLKV | 2 |
| 2327 | HGLEV | 2 |
| 2226 | HGPKV | 2 |
| 2328 | HHMVQ | 2 |
| 1962 | HILKA | 2 |
| 2329 | HKLKA | 2 |
| 2045 | HKLKE | 2 |
| 2231 | HKLKQ | 2 |
| 1921 | HRLKA | 2 |
| 2330 | HRLKQ | 2 |
| 1847 | HRLNE | 2 |
| 2082 | KGLKQ | 2 |
| 2331 | KTLKV | 2 |
| 2332 | PTLKV | 2 |
| 1972 | QSLIA | 2 |
| 2333 | RLLPY | 2 |
| 2334 | RLRPN | 2 |
| 2335 | RTLAQ | 2 |
| 2336 | RTLKV | 2 |
| 2337 | SALTV | 2 |
| 2338 | STLKL | 2 |
| 1916 | TGLKT | 2 |
| 2339 | TKLKQ | 2 |
| 1918 | TTLKI | 2 |
| 2340 | TTPKV | 2 |
| 2341 | AGLAS | 1 |
| 2342 | AGLKM | 1 |
| 2343 | APLKV | 1 |
| 1945 | ARLKV | 1 |
| 1992 | ARLRD | 1 |
| 2344 | ATLKG | 1 |
| 538 | DALKE | 1 |
| 1898 | DALKV | 1 |
| 2345 | DELRQ | 1 |
| 2346 | DGLKA | 1 |
| 1865 | DGLKE | 1 |
| 2347 | DGLKL | 1 |
| 2348 | DKLKG | 1 |
| 1877 | DRLKQ | 1 |
| 1952 | DRLRE | 1 |

TABLE 15-continued

ZF5 selection on G:A change at nt 7 of core motif in CBS.
Sequences reflect position 2 to 6.

| SEQ ID NO: | Sequence | Read # |
|---|---|---|
| 1904 | DRLRV | 1 |
| 2349 | DSLKV | 1 |
| 2195 | DTLKE | 1 |
| 2350 | DTLNQ | 1 |
| 326 | DTLQA | 1 |
| 423 | DTLRA | 1 |
| 533 | DTLRL | 1 |
| 2351 | DTLWQ | 1 |
| 2352 | DTMKV | 1 |
| 2353 | EGLKQ | 1 |
| 1955 | ERLRA | 1 |
| 1873 | ERLRE | 1 |
| 2023 | ERPRM | 1 |
| 2354 | ETLKE | 1 |
| 2355 | ETRRV | 1 |
| 2356 | GGLAV | 1 |
| 2357 | GGLRG | 1 |
| 2358 | GGLRV | 1 |
| 2359 | GHLKA | 1 |
| 2196 | GILND | 1 |
| 2028 | GMLKV | 1 |
| 2360 | GPLRA | 1 |
| 2361 | GQQHV | 1 |
| 2362 | GTLQA | 1 |
| 2363 | GTPKV | 1 |
| 2364 | HALES | 1 |
| 2365 | HALKF | 1 |
| 2366 | HALMV | 1 |
| 2033 | HALPV | 1 |
| 2367 | HAMKV | 1 |
| 2368 | HARKV | 1 |
| 2222 | HELKV | 1 |
| 2369 | HGLKD | 1 |
| 2370 | HGLKL | 1 |
| 2371 | HGLKM | 1 |
| 2372 | HGLKW | 1 |
| 2373 | HGRKI | 1 |
| 2041 | HGRKV | 1 |
| 2374 | HHLAQ | 1 |
| 2375 | HHLGQ | 1 |
| 2376 | HHLMQ | 1 |
| 2377 | HHMKV | 1 |
| 2044 | HILIA | 1 |
| 2228 | HILKV | 1 |
| 2230 | HKLKG | 1 |
| 2378 | HKLKM | 1 |
| 2379 | HKLNV | 1 |
| 2380 | HKLQE | 1 |
| 2046 | HKLRV | 1 |
| 2381 | HMLNV | 1 |
| 2382 | HPLDV | 1 |
| 2050 | HPLKV | 1 |
| 2383 | HPLQV | 1 |
| 2384 | HQLKA | 1 |
| 2385 | HQLKG | 1 |
| 2386 | HQLKT | 1 |
| 1868 | HRLAE | 1 |
| 2058 | HRLKG | 1 |
| 2059 | HRLKL | 1 |
| 1872 | HRLKR | 1 |
| 1912 | HRLRQ | 1 |
| 2065 | HRLVR | 1 |
| 2067 | HRPKE | 1 |
| 2387 | HSLKA | 1 |
| 1923 | HSLKE | 1 |
| 2388 | HSLKG | 1 |
| 2389 | HSLKL | 1 |
| 2241 | HSVKA | 1 |
| 2077 | HTLAQ | 1 |
| 2390 | HTLAV | 1 |
| 2243 | HTLEV | 1 |
| 2391 | HTLKN | 1 |

TABLE 15-continued

ZF5 selection on G:A change at nt 7 of core motif in CBS.
Sequences reflect position 2 to 6.

| SEQ ID NO: | Sequence | Read # |
|---|---|---|
| 2244 | HTLMV | 1 |
| 2392 | HTLNA | 1 |
| 2393 | HTLQV | 1 |
| 250 | HTLTE | 1 |
| 2394 | HTLTV | 1 |
| 2395 | HTPKV | 1 |
| 2396 | HTRKQ | 1 |
| 2397 | HVLKF | 1 |
| 2398 | HVMKV | 1 |
| 2399 | HWLKV | 1 |
| 2400 | KADTV | 1 |
| 2401 | KGLKG | 1 |
| 2402 | KRLKQ | 1 |
| 2403 | KTLAQ | 1 |
| 2404 | KTLRV | 1 |
| 2405 | KTLTQ | 1 |
| 2406 | LHLKV | 1 |
| 2407 | LTLKQ | 1 |
| 2408 | LTLKV | 1 |
| 2409 | MGLKV | 1 |
| 2410 | MPPK | 1 |
| 2411 | MRLKQ | 1 |
| 2412 | NAVTE | 1 |
| 2413 | NGLKG | 1 |
| 2414 | NGLKL | 1 |
| 2415 | NRLKG | 1 |
| 1914 | NRLRD | 1 |
| 1863 | NRLRV | 1 |
| 2416 | NTLRV | 1 |
| 2417 | PGLKV | 1 |
| 2418 | QGLKV | 1 |
| 1858 | QRLKV | 1 |
| 1938 | QRLRV | 1 |
| 2419 | QRQRV | 1 |
| 2420 | QTLKA | 1 |
| 2421 | QTLKG | 1 |

TABLE 15-continued

ZF5 selection on G:A change at nt 7 of core motif in CBS.
Sequences reflect position 2 to 6.

| SEQ ID NO: | Sequence | Read # |
|---|---|---|
| 2422 | QTLKK | 1 |
| 2423 | QTLKM | 1 |
| 2424 | QTLMV | 1 |
| 2125 | RGLKV | 1 |
| 2425 | RHLVQ | 1 |
| 2426 | RLLPT | 1 |
| 2427 | RLLSN | 1 |
| 2428 | RLMPD | 1 |
| 2429 | RMLPN | 1 |
| 2126 | RRLGD | 1 |
| 2430 | RSLKV | 1 |
| 2431 | RTLKG | 1 |
| 2432 | SALKQ | 1 |
| 2433 | SALRQ | 1 |
| 2434 | SELKV | 1 |
| 2435 | SFLKV | 1 |
| 2133 | SGLAM | 1 |
| 2436 | SGLKQ | 1 |
| 2437 | SHLKQ | 1 |
| 2438 | SKLKA | 1 |
| 2187 | SKLKE | 1 |
| 1888 | SRLKD | 1 |
| 2145 | SRLRA | 1 |
| 556 | SSLRV | 1 |
| 2152 | SSQRE | 1 |
| 2439 | STLKK | 1 |
| 2440 | STLKM | 1 |
| 385 | STLMV | 1 |
| 448 | STLQQ | 1 |
| 554 | STLTA | 1 |
| 2441 | STMKA | 1 |
| 2442 | STMKV | 1 |
| 2443 | TALKV | 1 |
| 2444 | TGLKA | 1 |
| 2445 | TGLKD | 1 |
| 1915 | TGLKE | 1 |

TABLE 15-continued

ZF5 selection on G:A change at nt 7 of core motif in CBS.
Sequences reflect position 2 to 6.

| SEQ ID NO: | Sequence | Read # |
|---|---|---|
| 2154 | TGLKG | 1 |
| 2446 | TGLMV | 1 |
| 2198 | THLKE | 1 |
| 2447 | THLKG | 1 |
| 2448 | THLKL | 1 |
| 2449 | THLKQ | 1 |
| 2450 | THLMV | 1 |
| 64 | TKLKV | 1 |
| 2451 | TPLQV | 1 |
| 1882 | TRLKD | 1 |
| 1981 | TRLKG | 1 |
| 2452 | TRLPQ | 1 |
| 1942 | TRLQE | 1 |
| 2453 | TTLEV | 1 |
| 2454 | TTLHV | 1 |
| 507 | TTLNQ | 1 |
| 577 | TTLQV | 1 |
| 2455 | TTLRG | 1 |
| 2456 | TTLYV | 1 |
| 2457 | TTMKV | 1 |
| 2458 | TVLRQ | 1 |
| 2459 | VGLGG | 1 |
| 2460 | VTLKV | 1 |

TABLE 16

ZF5 selection on G:A change position 8 of the CBS core motif.
Sequences reflect position 2 to 6.

| SEQ ID NO: | Sequence | # Read |
|---|---|---|
| 2461 | GGLRR | 341 |
| 50 | GGLVR | 336 |
| 2462 | TGLRR | 274 |
| 2463 | EGLRR | 267 |
| 1843 | DGLRR | 232 |
| 2464 | SGLRR | 206 |
| 2465 | AGLAR | 179 |
| 2466 | SGLAR | 178 |
| 2467 | GGLAR | 177 |
| 55 | GGLTR | 168 |
| 2468 | DGLAR | 152 |
| 1986 | AGLKR | 148 |
| 2469 | TGLAR | 135 |
| 1837 | DGLVR | 129 |
| 2470 | GGLQR | 127 |
| 70 | GNLTR | 124 |
| 117 | GNLVR | 123 |
| 2471 | HGLAR | 123 |
| 2027 | GGLKR | 111 |
| 2472 | TGLVR | 108 |
| 2473 | AGLTR | 105 |
| 2474 | SGLSR | 102 |
| 2475 | AGLRR | 100 |
| 2476 | GGLSR | 94 |
| 59 | HGLRR | 91 |
| 54 | HGLVR | 87 |
| 2477 | SGLTR | 84 |
| 2478 | NGLVR | 80 |
| 2479 | AGLQR | 79 |
| 118 | GNLRR | 79 |
| 2480 | AGLHR | 76 |
| 2481 | GNLER | 76 |
| 2482 | HNLLR | 76 |
| 138 | GNLAR | 73 |
| 1870 | DGLTR | 72 |
| 2483 | HALRR | 69 |
| 2484 | HGLQR | 69 |
| 2485 | NGLRR | 69 |
| 2486 | SGLVR | 68 |
| 2487 | SNLDR | 67 |
| 68 | TNLRR | 66 |
| 2488 | HGLTR | 63 |

TABLE 16-continued

ZF5
selection on G:A
change position 8 of the CBS core motif.
Sequences reflect position 2 to 6.

| SEQ ID NO: | Sequence | # Read |
|---|---|---|
| 2489 | SSLRR | 63 |
| 108 | DALRR | 61 |
| 2490 | EGLTR | 61 |
| 2491 | GGLER | 61 |
| 109 | DGLKR | 60 |
| 2492 | TGLQR | 60 |
| 56 | HTLRR | 59 |
| 1985 | AALKR | 58 |
| 1988 | AGLVR | 55 |
| 2493 | AGLIR | 54 |
| 1932 | HGLKR | 54 |
| 2494 | ANLVR | 53 |
| 2495 | EGLKR | 53 |
| 2496 | SNLLR | 51 |
| 2497 | EGLAR | 50 |
| 2498 | AGLSR | 49 |
| 2499 | DGLIR | 48 |
| 2500 | TGLKR | 48 |
| 2501 | SGLQR | 46 |
| 2502 | ETLKR | 45 |
| 2503 | HGLLR | 45 |
| 2504 | NGLQR | 45 |
| 2505 | TGLMR | 45 |
| 69 | ANLRR | 43 |
| 2506 | DNLVR | 42 |
| 2507 | TGLLR | 42 |
| 2508 | DGLMR | 41 |
| 2509 | ASLKR | 39 |
| 2510 | QGLRR | 38 |
| 2511 | TNLVR | 38 |
| 2512 | NGLTR | 37 |
| 2513 | SGLDR | 37 |
| 2514 | SGLHR | 37 |
| 2515 | TGLNR | 37 |
| 2516 | TGLSR | 37 |
| 2517 | GNLLR | 36 |
| 2518 | NNLVR | 36 |
| 2519 | TGLIR | 36 |
| 2520 | DMLRR | 35 |
| 2521 | GALKR | 35 |
| 2522 | GNLDR | 35 |
| 2523 | SALRR | 35 |
| 2524 | SNLAR | 35 |
| 2525 | SGLLR | 34 |
| 2526 | TNLNR | 33 |
| 2527 | AGLLR | 31 |
| 2528 | GGLIR | 31 |
| 2529 | DGLHR | 30 |
| 2530 | DTLRR | 30 |
| 2531 | HLLKR | 30 |
| 2532 | SALAR | 30 |
| 2533 | SMLAR | 30 |
| 2534 | VGLKR | 30 |
| 2535 | DNLLR | 28 |
| 2536 | GGLMR | 28 |
| 2537 | SGLMR | 28 |
| 2538 | AALRR | 27 |
| 2539 | ETLRR | 27 |
| 2540 | NGLAR | 27 |
| 2157 | TGLRV | 27 |
| 53 | TGLTR | 27 |
| 2541 | TNLQR | 27 |
| 2542 | ANLAR | 26 |
| 2543 | NNLAR | 26 |
| 2544 | SNLSR | 26 |
| 2545 | STLSR | 26 |
| 2546 | AALAR | 25 |
| 2547 | HALVR | 25 |
| 2548 | HGLSR | 25 |
| 2549 | SGLNR | 25 |
| 2550 | STLAR | 25 |

TABLE 16-continued

ZF5
selection on G:A
change position 8 of the CBS core motif.
Sequences reflect position 2 to 6.

| SEQ ID NO: | Sequence | # Read |
|---|---|---|
| 2551 | ANLIR | 24 |
| 2552 | DGLDR | 24 |
| 2553 | DGLSR | 24 |
| 2554 | GTLKR | 24 |
| 1884 | EALKR | 23 |
| 2555 | NGLSR | 23 |
| 2556 | SMLRR | 23 |
| 2557 | HNLHR | 22 |
| 2558 | HNLRR | 22 |
| 2559 | SGLKR | 22 |
| 2560 | TGLGR | 22 |
| 2561 | TNLMR | 22 |
| 1871 | DALVR | 21 |
| 2562 | GTLTR | 21 |
| 2563 | DGLNR | 20 |
| 2564 | SSLVR | 20 |
| 2565 | TGLER | 20 |
| 2566 | DTLKR | 19 |
| 2567 | GNLSR | 19 |
| 51 | HGLIR | 19 |
| 2568 | HSLVR | 19 |
| 2569 | AGLNR | 18 |
| 2570 | DALAR | 18 |
| 2571 | GGLHR | 18 |
| 2572 | NGLIR | 18 |
| 2573 | QGLTR | 18 |
| 2574 | QMLKR | 18 |
| 2575 | QNLRR | 18 |
| 1845 | TGLKV | 18 |
| 2576 | AILKR | 17 |
| 119 | GNLKR | 17 |
| 139 | GNLMR | 17 |
| 2577 | HNLTR | 17 |
| 2578 | HTLAR | 17 |
| 2579 | QGLKR | 17 |
| 2580 | SGLER | 17 |
| 2581 | SGLGR | 17 |
| 2582 | SNLVR | 17 |
| 2583 | EALRR | 16 |
| 2584 | GTLRR | 16 |
| 2585 | HGLGR | 16 |
| 2586 | HTLMR | 16 |
| 2587 | NTLRR | 16 |
| 2588 | TGLHR | 16 |
| 2589 | TSLRR | 16 |
| 2590 | TTLQR | 16 |
| 2591 | DNLKR | 15 |
| 2592 | GALTR | 15 |
| 2593 | QTLRR | 15 |
| 2594 | SGLIR | 15 |
| 2595 | TNLKR | 15 |
| 2596 | DGLGR | 14 |
| 2597 | DSLQR | 14 |
| 2598 | EGLNR | 14 |
| 2599 | ENLRR | 14 |
| 2600 | GSLRR | 14 |
| 2601 | NGLNR | 14 |
| 2602 | QALKR | 14 |
| 2603 | SALSR | 14 |
| 2604 | SSLGR | 14 |
| 2605 | VNLKR | 14 |
| 66 | ATLRR | 13 |
| 2005 | DGLLR | 13 |
| 2606 | EMLKR | 13 |
| 2607 | GALVR | 13 |
| 2608 | GNLGR | 13 |
| 2609 | GNLQR | 13 |
| 2610 | HALAR | 13 |
| 2611 | HSLIR | 13 |
| 2612 | HTLER | 13 |
| 2613 | HTLQR | 13 |

TABLE 16-continued

ZF5
selection on G:A
change position 8 of the CBS core motif.
Sequences reflect position 2 to 6.

| SEQ ID NO: | Sequence | # Read |
|---|---|---|
| 2614 | NGLER | 13 |
| 2615 | NGLMR | 13 |
| 2616 | QGLVR | 13 |
| 2617 | TALKR | 13 |
| 2618 | TTLMR | 13 |
| 2619 | VGLRR | 13 |
| 2620 | ANLKR | 12 |
| 2621 | ANLNR | 12 |
| 2622 | ATLTR | 12 |
| 2623 | DNLRR | 12 |
| 2624 | ENLKR | 12 |
| 2625 | GGLLR | 12 |
| 2626 | GTLVR | 12 |
| 2627 | HNLSR | 12 |
| 2628 | NTLKR | 12 |
| 2629 | SALER | 12 |
| 2630 | SSLTR | 12 |
| 2631 | TALVR | 12 |
| 52 | ANLSR | 11 |
| 2632 | DNLAR | 11 |
| 2633 | ENLSR | 11 |
| 2634 | ESLRR | 11 |
| 2635 | NALRR | 11 |
| 2636 | NGLKR | 11 |
| 2637 | NNLLR | 11 |
| 2418 | QGLKV | 11 |
| 116 | SNLRR | 11 |
| 2638 | STLRR | 11 |
| 2639 | VNLSR | 11 |
| 2640 | DMLKR | 10 |
| 2641 | GALRR | 10 |
| 2642 | GGLDR | 10 |
| 2643 | HGLMR | 10 |
| 2644 | HNLVR | 10 |
| 2645 | HQLIR | 10 |
| 2086 | NALKR | 10 |
| 1969 | NTLKV | 10 |
| 2646 | QNLQR | 10 |
| 1887 | SALKV | 10 |
| 2647 | SMLIR | 10 |
| 2648 | TALRV | 10 |
| 2649 | TNLAR | 10 |
| 2650 | TQLKR | 10 |
| 1849 | TTLKV | 10 |
| 2651 | TTLTR | 10 |
| 2652 | VGLQR | 10 |
| 2653 | AALSR | 9 |
| 2654 | ATLAR | 9 |
| 2655 | DALGR | 9 |
| 2656 | DTLNR | 9 |
| 2657 | EILKR | 9 |
| 2658 | ESLKR | 9 |
| 2659 | GGLNR | 9 |
| 2660 | GSLTR | 9 |
| 2661 | HNLAR | 9 |
| 2662 | MGLKR | 9 |
| 2663 | NGLHR | 9 |
| 2664 | NMLKR | 9 |
| 2665 | PNLKR | 9 |
| 2666 | SALTR | 9 |
| 2667 | SDLKR | 9 |
| 2668 | STLGR | 9 |
| 2669 | AGLER | 8 |
| 2670 | DILRR | 8 |
| 2671 | DMLNR | 8 |
| 2672 | DTLAR | 8 |
| 2673 | HALLR | 8 |
| 2674 | HALSR | 8 |
| 2675 | HNLGR | 8 |
| 2676 | NALVR | 8 |
| 2677 | SMLTR | 8 |

TABLE 16-continued

ZF5
selection on G:A
change position 8 of the CBS core motif.
Sequences reflect position 2 to 6.

| SEQ ID NO: | Sequence | # Read |
|---|---|---|
| 2678 | TALAR | 8 |
| 2679 | TNLER | 8 |
| 2680 | TNLGR | 8 |
| 2681 | TTLNR | 8 |
| 2682 | DALLR | 7 |
| 2683 | DSLAR | 7 |
| 2684 | GTLAR | 7 |
| 2685 | GTLLV | 7 |
| 2686 | HALIR | 7 |
| 2687 | HGLDR | 7 |
| 2688 | HGLER | 7 |
| 2689 | HTLLR | 7 |
| 2690 | NNLIR | 7 |
| 2691 | NNLMR | 7 |
| 2692 | QSLKR | 7 |
| 2693 | SALGR | 7 |
| 2694 | SALVR | 7 |
| 2695 | SNLMR | 7 |
| 2696 | SQLRR | 7 |
| 2697 | STLQR | 7 |
| 2698 | STLVR | 7 |
| 2699 | SVLKR | 7 |
| 2189 | TSLKV | 7 |
| 2700 | AALTR | 6 |
| 2701 | DSLKR | 6 |
| 2702 | DSLRR | 6 |
| 2703 | DTLMR | 6 |
| 2704 | EGLLR | 6 |
| 2705 | ENLAR | 6 |
| 2706 | GNLNR | 6 |
| 2707 | GTLQR | 6 |
| 2708 | HALDR | 6 |
| 2709 | HVLER | 6 |
| 2710 | IGLRR | 6 |
| 2711 | INLTR | 6 |

TABLE 16-continued

ZF5
selection on G:A
change position 8 of the CBS core motif.
Sequences reflect position 2 to 6.

| SEQ ID NO: | Sequence | # Read |
|---|---|---|
| 2712 | NMLRR | 6 |
| 2713 | QMLRR | 6 |
| 2714 | TNLHR | 6 |
| 2715 | TSLHR | 6 |
| 2716 | VGLAR | 6 |
| 2717 | AALQR | 5 |
| 2718 | AGLDR | 5 |
| 48 | ATLKR | 5 |
| 1833 | DGLKK | 5 |
| 2719 | DTLQR | 5 |
| 2720 | DVLKR | 5 |
| 2721 | GALSR | 5 |
| 2722 | GMLKR | 5 |
| 2723 | GTLSR | 5 |
| 2724 | HNLER | 5 |
| 2725 | NGLLV | 5 |
| 2726 | NNLTR | 5 |
| 2727 | QALAV | 5 |
| 2728 | QGLAR | 5 |
| 2729 | QNLHR | 5 |
| 2730 | SALMR | 5 |
| 2731 | SLLLR | 5 |
| 2732 | SVLAR | 5 |
| 2733 | SVLTR | 5 |
| 2734 | TALRR | 5 |
| 74 | TMLRR | 5 |
| 2735 | TQLRV | 5 |
| 2736 | TTLLR | 5 |
| 2737 | TTLRR | 5 |
| 2738 | AALNR | 4 |
| 2739 | ATLVR | 4 |
| 2740 | DALHR | 4 |
| 2741 | DALMR | 4 |
| 2742 | DGLER | 4 |
| 2743 | DGLQR | 4 |
| 45 | DGLRV | 4 |

TABLE 16-continued

ZF5
selection on G:A
change position 8 of the CBS core motif.
Sequences reflect position 2 to 6.

| SEQ ID NO: | Sequence | # Read |
|---|---|---|
| 2744 | DLLRR | 4 |
| 1855 | DRLKV | 4 |
| 2745 | GGLGR | 4 |
| 2746 | GNLHR | 4 |
| 1892 | GTLKV | 4 |
| 2747 | GTLNR | 4 |
| 2748 | HALHR | 4 |
| 2749 | HALMR | 4 |
| 2750 | HILTR | 4 |
| 2751 | HLLLR | 4 |
| 2752 | HNLQR | 4 |
| 2753 | HTLGR | 4 |
| 2754 | IGLTG | 4 |
| 2755 | NGLLR | 4 |
| 2756 | NSLRR | 4 |
| 2757 | PNLIR | 4 |
| 2758 | PNLRR | 4 |
| 2759 | SALIR | 4 |
| 2760 | SILGR | 4 |
| 2761 | SPLVR | 4 |
| 2762 | STLTR | 4 |
| 2763 | TALKT | 4 |
| 2764 | TALTR | 4 |
| 2765 | TGLDR | 4 |
| 2766 | TSLKR | 4 |
| 2767 | TTLVR | 4 |
| 2768 | VGLQN | 4 |
| 2769 | VNLRR | 4 |
| 2770 | AALVR | 3 |
| 58 | ADLKR | 3 |
| 2771 | ANLGR | 3 |
| 2772 | ATLSR | 3 |
| 2773 | DNLQR | 3 |
| 2774 | DNLTR | 3 |
| 2775 | DRLRR | 3 |
| 2776 | DTLVR | 3 |
| 2777 | EGLVR | 3 |
| 2778 | GALNR | 3 |
| 2779 | GDLKR | 3 |
| 2780 | GDLTR | 3 |
| 62 | GGLGL | 3 |
| 2781 | GSLQR | 3 |
| 1930 | HALKR | 3 |
| 2782 | HGLHR | 3 |
| 1866 | HGLRV | 3 |
| 2783 | HTLKR | 3 |
| 2784 | HVLKR | 3 |
| 2785 | NGLDR | 3 |
| 2786 | NMLAR | 3 |
| 2787 | NSLAR | 3 |
| 2788 | NTLAR | 3 |
| 2789 | QGLHR | 3 |
| 2134 | SGLAV | 3 |
| 2790 | SILTR | 3 |
| 2791 | SILVR | 3 |
| 2792 | SQLKR | 3 |
| 2793 | SSLQR | 3 |
| 2794 | TALHR | 3 |
| 2795 | TALNR | 3 |
| 2796 | TALSR | 3 |
| 2797 | AGLGR | 2 |
| 2798 | AGLMR | 2 |
| 2799 | ASLQR | 2 |
| 2800 | ASLVR | 2 |
| 2801 | ATLMR | 2 |
| 2802 | AVLKR | 2 |
| 2803 | DALNR | 2 |
| 2804 | DALQR | 2 |
| 2805 | DALSR | 2 |
| 1853 | DGLRK | 2 |
| 2806 | DHLHR | 2 |

TABLE 16-continued

ZF5
selection on G:A
change position 8 of the CBS core motif.
Sequences reflect position 2 to 6.

| SEQ ID NO: | Sequence | # Read |
|---|---|---|
| 2807 | DHLVR | 2 |
| 2808 | DNLSR | 2 |
| 2809 | DTLSR | 2 |
| 2810 | DTLTR | 2 |
| 2811 | DVLRR | 2 |
| 2812 | EGLIR | 2 |
| 2813 | EGLSR | 2 |
| 2814 | GAEE . . . | 2 |
| 2815 | GALQR | 2 |
| 2319 | GALRV | 2 |
| 2816 | GDLRR | 2 |
| 2817 | GDLVR | 2 |
| 1957 | GGLKV | 2 |
| 2358 | GGLRV | 2 |
| 2818 | GSLAR | 2 |
| 2819 | GSLKR | 2 |
| 2820 | HDLRR | 2 |
| 2821 | HGLNR | 2 |
| 2822 | HHLIR | 2 |
| 2047 | HMLKR | 2 |
| 2823 | HMLRR | 2 |
| 2824 | HQLVR | 2 |
| 2825 | HSLAR | 2 |
| 2826 | HSLHR | 2 |
| 2827 | HSLRR | 2 |
| 46 | HTLKV | 2 |
| 2828 | HTLNR | 2 |
| 2829 | HTLTR | 2 |
| 2830 | HTLVR | 2 |
| 2831 | IGLKR | 2 |
| 2832 | ITLKR | 2 |
| 2833 | MTLKR | 2 |
| 2834 | NALHR | 2 |
| 2835 | NALSR | 2 |
| 2836 | NGLGR | 2 |
| 2837 | NTLHR | 2 |
| 2838 | QDLKR | 2 |
| 2839 | QGLLR | 2 |
| 2840 | QNLLR | 2 |
| 2841 | QNLRW | 2 |
| 2842 | QSLRR | 2 |
| 2843 | QTLKR | 2 |
| 2131 | SALKR | 2 |
| 2844 | SALRV | 2 |
| 2845 | SSLAR | 2 |
| 2846 | SSLSR | 2 |
| 2847 | STLDR | 2 |
| 2848 | STLER | 2 |
| 2849 | STLHR | 2 |
| 1851 | STLKV | 2 |
| 2850 | STLMR | 2 |
| 2851 | TALGR | 2 |
| 2852 | TGLAT | 2 |
| 2853 | TGLSV | 2 |
| 2854 | TGLVT | 2 |
| 2855 | TNLKV | 2 |
| 2856 | TNLSR | 2 |
| 2857 | TTLAR | 2 |
| 2858 | TTLGR | 2 |
| 2859 | TTLIR | 2 |
| 2860 | TTLKR | 2 |
| 2179 | TTLKT | 2 |
| 2861 | TVLRM | 2 |
| 2862 | VQLAM | 2 |
| 2863 | VTLTR | 2 |
|  | A*S . . . | 1 |
| 2864 | AALLR | 1 |
| 2865 | AALMR | 1 |
| 2866 | AAPER | 1 |
| 2867 | ADLRR | 1 |
| 2868 | AGLAW | 1 |

TABLE 16-continued

ZF5
selection on G:A
change position 8 of the CBS core motif.
Sequences reflect position 2 to 6.

| SEQ ID NO: | Sequence | # Read |
|---|---|---|
| 2869 | AGLRW | 1 |
| 2870 | AGLTS | 1 |
| 2871 | AILTR | 1 |
| 71 | AMLKR | 1 |
| 2872 | ANLPR | 1 |
| 1944 | ARLKR | 1 |
| 2873 | ARLQR | 1 |
| 2874 | ARLTR | 1 |
| 2875 | ASLRR | 1 |
| 2876 | ASLTR | 1 |
| 2877 | ATLDR | 1 |
| 2878 | ATLER | 1 |
| 2879 | ATLIR | 1 |
| 2880 | ATLLR | 1 |
| 2881 | ATLQR | 1 |
| 2882 | AVLRR | 1 |
| 1831 | DALKR | 1 |
| 1950 | DALRV | 1 |
| 2883 | DGLSV | 1 |
| 2884 | DILHR | 1 |
| 2885 | DQLRR | 1 |
| 2886 | DSLSR | 1 |
| 2887 | DTLAK | 1 |
| 2888 | DVLLR | 1 |
| 2889 | EALNR | 1 |
| 2890 | EALTR | 1 |
| 1953 | EGLKV | 1 |
| 2891 | EGLMR | 1 |
| 2892 | EGLQR | 1 |
| 2893 | EGLRL | 1 |
| 2894 | EGLRV | 1 |
| 2895 | EGVRR | 1 |
| 2896 | ELLRR | 1 |
| 2897 | ENLER | 1 |
| 2898 | ETLLR | 1 |
| 2899 | GALHR | 1 |
| 2900 | GGHRR | 1 |
| 2901 | GGLAG | 1 |
| 2356 | GGLAV | 1 |
| 2902 | GGLDV | 1 |
| 2903 | GGLGS | 1 |
| 2904 | GGLQE | 1 |
| 2905 | GGLVL | 1 |
| 1958 | GGLVT | 1 |
| 2906 | GGPSH | 1 |
| 2907 | GGPSR | 1 |
| 2908 | GGQRR | 1 |
| 2909 | GGVRR | 1 |
| 2910 | GGWR . . . | 1 |
| 2911 | GILER | 1 |
| 2912 | GKLRR | 1 |
| 2913 | GMLAR | 1 |
| 2914 | GNLIR | 1 |
| 2915 | GSLER | 1 |
| 2916 | GSLVR | 1 |
| 2917 | GTLER | 1 |
| 2918 | GTLGR | 1 |
| 2919 | GTLHR | 1 |
| 2920 | GTQVR | 1 |
| 2921 | GVLRR | 1 |
| 2922 | GVLTR | 1 |
| 2923 | HALGR | 1 |
| 43 | HALKV | 1 |
| 2924 | HDLAK | 1 |
| 2925 | HGAAR | 1 |
| 2035 | HGLKK | 1 |
| 2371 | HGLKM | 1 |
| 41 | HGLKV | 1 |
| 2926 | HGLSV | 1 |
| 2927 | HGLTW | 1 |
| 2928 | HGPAR | 1 |

TABLE 16-continued

ZF5
selection on G:A
change position 8 of the CBS core motif.
Sequences reflect position 2 to 6.

| SEQ ID NO: | Sequence | # Read |
|---|---|---|
| 2929 | HKLAR | 1 |
| 2930 | HNLLS | 1 |
| 2931 | HRLSR | 1 |
| 2932 | HSLNR | 1 |
| 2933 | HSLSR | 1 |
| 2934 | HTLHR | 1 |
| 2935 | HVLAR | 1 |
| 2936 | INLSR | 1 |
| 2937 | NALAR | 1 |
| 2938 | NHLVQ | 1 |
| 2939 | NTLIR | 1 |
| 2940 | NTLNR | 1 |
| 2941 | NTLQR | 1 |
| 2942 | NVLKR | 1 |
| 2943 | PALKR | 1 |
| 2944 | PGLLR | 1 |
|  | PWS . . . | 1 |
| 2945 | QAAWG . . . | 1 |
| 2946 | QALAR | 1 |
| 2947 | QALTR | 1 |
| 2948 | QDLIR | 1 |
| 2949 | QTLAR | 1 |
| 2950 | QTLQR | 1 |
| 2951 | QVLRR | 1 |
| 2952 | RGLTR | 1 |
| 2953 | RGLVR | 1 |
| 2954 | SALDR | 1 |
| 2955 | SALMC | 1 |
| 2956 | SALNR | 1 |
| 2957 | SDLAR | 1 |
| 2958 | SDLQR | 1 |
| 2959 | SDLRR | 1 |
| 2960 | SGPRR | 1 |
| 2961 | SLLSD | 1 |
| 2962 | SMLHR | 1 |
| 2963 | SNLQR | 1 |
| 2964 | SSLIR | 1 |
| 2965 | SSLKR | 1 |
| 2966 | STLLR | 1 |
| 2967 | STLNR | 1 |
| 2968 | STLRK | 1 |
| 2969 | SVLGR | 1 |
| 2970 | SVLRR | 1 |
| 2971 | TALER | 1 |
| 2972 | TALRT | 1 |
| 2973 | TDLAR | 1 |
| 2974 | TDLRR | 1 |
| 2975 | TGLQV | 1 |
| 2976 | TGLVRR | 1 |
| 2977 | TGPAR | 1 |
| 2978 | TMLKR | 1 |
| 2979 | TNLPR | 1 |
| 2980 | TSLAR | 1 |
| 2981 | TSLGG | 1 |
| 2982 | TSLGR | 1 |
| 2983 | TSLQR | 1 |
| 2984 | TSLVR | 1 |
| 2985 | VALAR | 1 |
| 2986 | VALKR | 1 |
| 2987 | VALSR | 1 |
| 2988 | VGLKC | 1 |
| 2989 | VGLSR | 1 |
| 2990 | VGLTM | 1 |
| 2991 | VNLAR | 1 |
| 2992 | VNLIR | 1 |
| 2993 | VNLNR | 1 |
| 2994 | VTLGR | 1 |
| 2995 | VTLKR | 1 |
| 2996 | VTLMR | 1 |
| 2997 | VTLRR | 1 |
| 2998 | WGLER | 1 |

TABLE 17

ZF5
selection on G:C
change at nt 8 of core motif in CBS.
Sequences reflect position 2 to 6.

| SEQ ID NO: | Sequence | # Read |
|---|---|---|
| 1843 | DGLRR | 498 |
| 108 | DALRR | 388 |
| 2463 | EGLRR | 348 |
| 1871 | DALVR | 288 |
| 1837 | DGLVR | 262 |
| 2468 | DGLAR | 261 |
| 1986 | AGLKR | 257 |
| 1870 | DGLTR | 255 |
| 2462 | TGLRR | 237 |
| 2530 | DTLRR | 196 |
| 59 | HGLRR | 192 |
| 66 | ATLRR | 176 |
| 2539 | ETLRR | 149 |
| 2464 | SGLRR | 142 |
| 2584 | GTLRR | 136 |
| 50 | GGLVR | 132 |
| 2545 | STLSR | 132 |
| 2707 | GTLQR | 131 |
| 2553 | DGLSR | 127 |
| 2027 | GGLKR | 126 |
| 2684 | GTLAR | 123 |
| 2578 | HTLAR | 114 |
| 2486 | SGLVR | 111 |
| 2779 | GDLKR | 109 |
| 2593 | QTLRR | 107 |
| 2472 | TGLVR | 106 |
| 2668 | STLGR | 103 |
| 2776 | DTLVR | 102 |
| 2563 | DGLNR | 100 |
| 2811 | DVLRR | 100 |
| 2698 | STLVR | 100 |
| 2720 | DVLKR | 99 |
| 48 | ATLKR | 96 |
| 2461 | GGLRR | 93 |
| 2638 | STLRR | 93 |
| 2802 | AVLKR | 91 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2816 | GDLRR | 90 |
| 2554 | GTLKR | 89 |
| 1932 | HGLKR | 89 |
| 56 | HTLRR | 89 |
| 2492 | TGLQR | 87 |
| 2559 | SGLKR | 86 |
| 2672 | DTLAR | 84 |
| 2654 | ATLAR | 83 |
| 2848 | STLER | 81 |
| 2737 | TTLRR | 80 |
| 2495 | EGLKR | 79 |
| 2562 | GTLTR | 79 |
| 2469 | TGLAR | 75 |
| 2529 | DGLHR | 74 |
| 54 | HGLVR | 74 |
| 2828 | HTLNR | 73 |
| 2967 | STLNR | 71 |
| 2489 | SSLRR | 69 |
| 2516 | TGLSR | 68 |
| 2772 | ATLSR | 67 |
| 2656 | DTLNR | 67 |
| 2788 | NTLAR | 66 |
| 58 | ADLKR | 65 |
| 2570 | DALAR | 65 |
| 2626 | GTLVR | 64 |
| 2719 | DTLQR | 62 |
| 2739 | ATLVR | 61 |
| 2478 | NGLVR | 61 |
| 109 | DGLKR | 59 |
| 2467 | GGLAR | 59 |
| 2568 | HSLVR | 59 |
| 2804 | DALQR | 58 |
| 2507 | TGLLR | 58 |
| 2640 | DMLKR | 57 |
| 55 | GGLTR | 56 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2867 | ADLRR | 55 |
| 2474 | SGLSR | 55 |
| 2564 | SSLVR | 54 |
| 2500 | TGLKR | 53 |
| 2475 | AGLRR | 52 |
| 2550 | STLAR | 52 |
| 2783 | HTLKR | 51 |
| 2587 | NTLRR | 51 |
| 2857 | TTLAR | 51 |
| 2622 | ATLTR | 49 |
| 2817 | GDLVR | 49 |
| 2667 | SDLKR | 49 |
| 2767 | TTLVR | 49 |
| 2466 | SGLAR | 48 |
| 2847 | STLDR | 48 |
| 2850 | STLMR | 48 |
| 2515 | TGLNR | 48 |
| 2502 | ETLKR | 47 |
| 2970 | SVLRR | 47 |
| 2849 | STLHR | 46 |
| 2959 | SDLRR | 45 |
| 2699 | SVLKR | 44 |
| 2488 | HGLTR | 43 |
| 2702 | DSLRR | 42 |
| 2974 | TDLRR | 42 |
| 2471 | HGLAR | 40 |
| 2586 | HTLMR | 40 |
| 2477 | SGLTR | 40 |
| 2966 | STLLR | 40 |
| 2736 | TTLLR | 40 |
| 2636 | NGLKR | 39 |
| 2810 | DTLTR | 38 |
| 2598 | EGLNR | 37 |
| 2723 | GTLSR | 37 |
| 2978 | TMLKR | 37 |
| 2589 | TSLRR | 37 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2801 | ATLMR | 36 |
| 2999 | DALTR | 36 |
| 2697 | STLQR | 36 |
| 2762 | STLTR | 36 |
| 2780 | GDLTR | 35 |
| 2476 | GGLSR | 35 |
| 51 | HGLIR | 35 |
| 2509 | ASLKR | 34 |
| 2630 | SSLTR | 34 |
| 1985 | AALKR | 33 |
| 3000 | DALIR | 33 |
| 2859 | TTLIR | 33 |
| 2490 | EGLTR | 32 |
| 2753 | HTLGR | 32 |
| 2613 | HTLQR | 32 |
| 2692 | QSLKR | 32 |
| 2701 | DSLKR | 31 |
| 2131 | SALKR | 31 |
| 2845 | SSLAR | 31 |
| 2618 | TTLMR | 31 |
| 2878 | ATLER | 30 |
| 2086 | NALKR | 30 |
| 2594 | SGLIR | 30 |
| 2556 | SMLRR | 30 |
| 3001 | GVLKR | 29 |
| 53 | TGLTR | 29 |
| 2497 | EGLAR | 28 |
| 2612 | HTLER | 28 |
| 2766 | TSLKR | 28 |
| 3002 | GDLHR | 27 |
| 2644 | HNLVR | 27 |
| 1936 | HTLRV | 27 |
| 2465 | AGLAR | 26 |
| 3003 | GDLNR | 26 |
| 2503 | HGLLR | 26 |

TABLE 17-continued

ZF5
selection on G:C
change at nt 8 of core motif in CBS.
Sequences reflect position 2 to 6.

| SEQ ID NO: | Sequence | # Read |
|---|---|---|
| 3004 | SILKR | 26 |
| 2858 | TTLGR | 26 |
| 2499 | DGLIR | 25 |
| 2732 | SVLAR | 25 |
| 2590 | TTLQR | 25 |
| 2473 | AGLTR | 24 |
| 1988 | AGLVR | 24 |
| 2805 | DALSR | 24 |
| 3005 | DTLIR | 24 |
| 2777 | EGLVR | 24 |
| 2579 | QGLKR | 24 |
| 2820 | HDLRR | 23 |
| 2784 | HVLKR | 23 |
| 3006 | NTLTR | 23 |
| 2957 | SDLAR | 23 |
| 2965 | SSLKR | 23 |
| 2973 | TDLAR | 23 |
| 2803 | DALNR | 22 |
| 3007 | HTLIR | 22 |
| 2628 | NTLKR | 22 |
| 2838 | QDLKR | 22 |
| 2860 | TTLKR | 22 |
| 3008 | EVLRR | 21 |
| 3009 | GDLSR | 21 |
| 3010 | HVLRR | 21 |
| 2837 | NTLHR | 21 |
| 3011 | TDLTR | 21 |
| 2681 | TTLNR | 21 |
| 1833 | DGLKK | 20 |
| 2520 | DMLRR | 20 |
| 2919 | GTLHR | 20 |
| 2833 | MTLKR | 20 |
| 2980 | TSLAR | 20 |
| 3012 | ATLHR | 19 |
| 3013 | DSLVR | 19 |
| 3014 | GTLDR | 19 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2830 | HTLVR | 19 |
| 3015 | NTLLR | 19 |
| 2843 | QTLKR | 19 |
| 2634 | ESLRR | 18 |
| 3016 | HDLQR | 18 |
| 2821 | HGLNR | 18 |
| 2823 | HMLRR | 18 |
| 57 | TVLKR | 18 |
| 3017 | ATLNR | 17 |
| 2596 | DGLGR | 17 |
| 2485 | NGLRR | 17 |
| 2549 | SGLNR | 17 |
| 2501 | SGLQR | 17 |
| 3018 | STLIR | 16 |
| 2617 | TALKR | 16 |
| 2519 | TGLIR | 16 |
| 3019 | TTLSR | 16 |
| 3020 | DILKR | 15 |
| 3021 | ETLNR | 15 |
| 2916 | GSLVR | 15 |
| 3022 | MDLKR | 15 |
| 2504 | NGLQR | 15 |
| 2949 | QTLAR | 15 |
| 2964 | SSLIR | 15 |
| 2538 | AALRR | 14 |
| 2818 | GSLAR | 14 |
| 2484 | HGLQR | 14 |
| 2512 | NGLTR | 14 |
| 3023 | QDLRR | 14 |
| 2588 | TGLHR | 14 |
| 3024 | TSLTR | 14 |
| 71 | AMLKR | 13 |
| 3025 | ATLGR | 13 |
| 3026 | GDLQR | 13 |
| 2470 | GGLQR | 13 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2819 | GSLKR | 13 |
| 3027 | NTLVR | 13 |
| 3028 | SILRR | 13 |
| 2582 | SNLVR | 13 |
| 2846 | SSLSR | 13 |
| 2995 | VTLKR | 13 |
| 2880 | ATLLR | 12 |
| 2597 | DSLQR | 12 |
| 2659 | GGLNR | 12 |
| 2548 | HGLSR | 12 |
| 2525 | SGLLR | 12 |
| 2792 | SQLKR | 12 |
| 2505 | TGLMR | 12 |
| 2982 | TSLGR | 12 |
| 2479 | AGLQR | 11 |
| 2670 | DILRR | 11 |
| 3029 | DTLER | 11 |
| 3030 | DTLLR | 11 |
| 2917 | GTLER | 11 |
| 2689 | HTLLR | 11 |
| 2540 | NGLAR | 11 |
| 2663 | NGLHR | 11 |
| 3031 | SDLTR | 11 |
| 3032 | SMLKR | 11 |
| 1849 | TTLKV | 11 |
| 2879 | ATLIR | 10 |
| 2722 | GMLKR | 10 |
| 2600 | GSLRR | 10 |
| 3033 | GTLLR | 10 |
| 2510 | QGLRR | 10 |
| 2480 | AGLHR | 9 |
| 2498 | AGLSR | 9 |
| 2740 | DALHR | 9 |
| 2005 | DGLLR | 9 |
| 3034 | DTLGR | 9 |
| 3035 | GDLAR | 9 |
| 1930 | HALKR | 9 |
| 2782 | HGLHR | 9 |
| 46 | HTLKV | 9 |
| 3036 | HVLVR | 9 |
| 2664 | NMLKR | 9 |
| 2939 | NTLIR | 9 |
| 3037 | QDLAR | 9 |
| 2560 | TGLGR | 9 |
| 2875 | ASLRR | 8 |
| 2881 | ATLQR | 8 |
| 3038 | ETLAR | 8 |
| 2592 | GALTR | 8 |
| 2607 | GALVR | 8 |
| 2547 | HALVR | 8 |
| 2643 | HGLMR | 8 |
| 3039 | HILKR | 8 |
| 3040 | HMLVR | 8 |
| 2827 | HSLRR | 8 |
| 3041 | NTLSR | 8 |
| 2948 | QDLIR | 8 |
| 3042 | SDLVR | 8 |
| 2537 | SGLMR | 8 |
| 2677 | SMLTR | 8 |
| 2189 | TSLKV | 8 |
| 2651 | TTLTR | 8 |
| 2700 | AALTR | 7 |
| 3043 | ETLQR | 7 |
| 2521 | GALKR | 7 |
| 2641 | GALRR | 7 |
| 2528 | GGLIR | 7 |
| 117 | GNLVR | 7 |
| 3044 | HDLGR | 7 |
| 3045 | HDLTR | 7 |
| 2826 | HSLHR | 7 |
| 2934 | HTLHR | 7 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2942 | NVLKR | 7 |
| 2678 | TALAR | 7 |
| 3046 | TDLKR | 7 |
| 1845 | TGLKV | 7 |
| 3047 | TSLNR | 7 |
| 2983 | TSLQR | 7 |
| 3048 | VDLKR | 7 |
| 2014 | DVLKK | 6 |
| 3049 | GILKR | 6 |
| 2921 | GVLRR | 6 |
| 2610 | HALAR | 6 |
| 2483 | HALRR | 6 |
| 2531 | HLLKR | 6 |
| 3050 | HNLKR | 6 |
| 2834 | NALHR | 6 |
| 3051 | QDLQR | 6 |
| 2616 | QGLVR | 6 |
| 2532 | SALAR | 6 |
| 3052 | SDLGR | 6 |
| 2514 | SGLHR | 6 |
| 2302 | STLKT | 6 |
| 3053 | TDLSR | 6 |
| 2565 | TGLER | 6 |
| 2742 | DGLER | 5 |
| 3054 | DILVR | 5 |
| 2566 | DTLKR | 5 |
| 1884 | EALKR | 5 |
| 2657 | EILKR | 5 |
| 3055 | GVLVG | 5 |
| 3056 | HSLTR | 5 |
| 3057 | HTLDR | 5 |
| 2937 | NALAR | 5 |
| 2572 | NGLIR | 5 |
| 2555 | NGLSR | 5 |
| 3058 | QQLQR | 5 |
| 2523 | SALRR | 5 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2694 | SALVR | 5 |
| 2513 | SGLDR | 5 |
| 2581 | SGLGR | 5 |
| 2496 | SNLLR | 5 |
| 3059 | SVLLR | 5 |
| 3060 | TDLGR | 5 |
| 3061 | TDLQR | 5 |
| 2534 | VGLKR | 5 |
| 2493 | AGLIR | 4 |
| 2576 | AILKR | 4 |
| 3062 | ALLKR | 4 |
| 2683 | DSLAR | 4 |
| 2886 | DSLSR | 4 |
| 3063 | DTLRK | 4 |
| 3064 | ETLTR | 4 |
| 3065 | GELTR | 4 |
| 70 | GNLTR | 4 |
| 2660 | GSLTR | 4 |
| 2918 | GTLGR | 4 |
| 2748 | HALHR | 4 |
| 3066 | HDLNR | 4 |
| 2482 | HNLLR | 4 |
| 3067 | MTLRR | 4 |
| 2615 | NGLMR | 4 |
| 3068 | NTLER | 4 |
| 2956 | SALNR | 4 |
| 2958 | SDLQR | 4 |
| 3069 | SELKR | 4 |
| 2580 | SGLER | 4 |
| 2604 | SSLGR | 4 |
| 3070 | STLSM | 4 |
| 3071 | TDLMR | 4 |
| 68 | TNLRR | 4 |
| 2650 | TQLKR | 4 |
| 3072 | TSLLR | 4 |

TABLE 17-continued

ZF5
selection on G:C
change at nt 8 of core motif in CBS.
Sequences reflect position 2 to 6.

| SEQ ID NO: | Sequence | # Read |
|---|---|---|
| 3073 | TSLMR | 4 |
| 2984 | TSLVR | 4 |
| 3074 | TTLER | 4 |
| 3075 | TVLRR | 4 |
| 2738 | AALNR | 3 |
| 3076 | ADLTR | 3 |
| 2669 | AGLER | 3 |
| 2542 | ANLAR | 3 |
| 69 | ANLRR | 3 |
| 2877 | ATLDR | 3 |
| 2741 | DALMR | 3 |
| 3077 | DILTR | 3 |
| 3078 | DMLQR | 3 |
| 2632 | DNLAR | 3 |
| 2591 | DNLKR | 3 |
| 2809 | DTLSR | 3 |
| 3079 | DVLVR | 3 |
| 2583 | EALRR | 3 |
| 2813 | EGLSR | 3 |
| 3080 | ETLRK | 3 |
| 2481 | GNLER | 3 |
| 3081 | GTLMR | 3 |
| 2747 | GTLNR | 3 |
| 3082 | HAEG . . . | 3 |
| 3083 | HDLMR | 3 |
| 3084 | HMLQR | 3 |
| 2577 | HNLTR | 3 |
| 3085 | HSLKR | 3 |
| 2829 | HTLTR | 3 |
| 2935 | HVLAR | 3 |
| 2835 | NALSR | 3 |
| 2518 | NNLVR | 3 |
| 3086 | QSLNR | 3 |
| 3087 | SILAR | 3 |
| 2962 | SMLHR | 3 |
| 297 | STLRV | 3 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2733 | SVLTR | 3 |
| 3088 | SVLVR | 3 |
| 2734 | TALRR | 3 |
| 2981 | TSLGG | 3 |
| 2994 | VTLGR | 3 |
| 2546 | AALAR | 2 |
| 2864 | AALLR | 2 |
| 2770 | AALVR | 2 |
| 3089 | ADLVR | 2 |
| 2569 | AGLNR | 2 |
| 2494 | ANLVR | 2 |
| 3090 | ASLAR | 2 |
| 3091 | ASLIR | 2 |
| 2800 | ASLVR | 2 |
| 2655 | DALGR | 2 |
| 3552 | DGLDR | 2 |
| 2743 | DGLQR | 2 |
| 1853 | DGLRK | 2 |
| 2506 | DNLVR | 2 |
| 3092 | DVLMR | 2 |
| 3093 | DVLQR | 2 |
| 3094 | EGLGR | 2 |
| 3095 | EGLHR | 2 |
| 2892 | EGLQR | 2 |
| 2658 | ESLKR | 2 |
| 2536 | GGLMR | 2 |
| 138 | GNLAR | 2 |
| 139 | GNLMR | 2 |
| 3096 | HDLSR | 2 |
| 2687 | HGLDR | 2 |
| 2585 | HGLGR | 2 |
| 2371 | HGLKM | 2 |
| 3097 | HILMR | 2 |
| 2557 | HNLHR | 2 |
| 2627 | HNLSR | 2 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2611 | HSLIR | 2 |
| 3098 | HSLQR | 2 |
| 3099 | HVLHR | 2 |
| 3100 | IDLKR | 2 |
| 2755 | NGLLR | 2 |
| 3101 | NILVR | 2 |
| 2943 | PALKR | 2 |
| 3102 | PGLAR | 2 |
| 3103 | PTLMR | 2 |
| 2573 | QGLTR | 2 |
| 2574 | QMLKR | 2 |
| 2842 | QSLRR | 2 |
| 3104 | QTLSR | 2 |
| 2759 | SALIR | 2 |
| 2603 | SALSR | 2 |
| 3105 | SELRR | 2 |
| 2487 | SNLDR | 2 |
| 116 | SNLRR | 2 |
| 2544 | SNLSR | 2 |
| 2696 | SQLRR | 2 |
| 2153 | STLKR | 2 |
| 2968 | STLRK | 2 |
| 3106 | TDLHR | 2 |
| 3107 | TDLVR | 2 |
| 3108 | TGLKL | 2 |
| 2157 | TGLRV | 2 |
| 3109 | TMLNR | 2 |
| 2649 | TNLAR | 2 |
| 2595 | TNLKR | 2 |
| 2511 | TNLVR | 2 |
| 3110 | TSLIR | 2 |
| 2176 | TTLKA | 2 |
| 3111 | VDLRR | 2 |
| 3112 | VTLAR | 2 |
| 3113 | AALHR | 1 |
| 2717 | AALQR | 1 |
| 2866 | AAPER | 1 |
| 3114 | ADLNR | 1 |
| 3115 | ADLRV | 1 |
| 2868 | AGLAW | 1 |
| 3116 | AGLKK | 1 |
| 2527 | AGLLR | 1 |
| 3117 | AILRR | 1 |
| 2621 | ANLNR | 1 |
| 3118 | ASLKS | 1 |
| 2799 | ASLQR | 1 |
| 2876 | ASLTR | 1 |
| 3119 | ASMKR | 1 |
| 3120 | ATPVP | 1 |
| 2882 | AVLRR | 1 |
| 3121 | AVLTR | 1 |
| 3122 | CGLRR | 1 |
| 3123 | DAEA . . . | 1 |
| 3124 | DALER | 1 |
| 1831 | DALKR | 1 |
| 2682 | DALLR | 1 |
| 3125 | DALPR | 1 |
| 3126 | DARRR | 1 |
| 3127 | DDLNR | 1 |
| 3128 | DGAAE . . . | 1 |
| 1852 | DGLKV | 1 |
| 3129 | DGLWR | 1 |
| 3130 | DGPAR | 1 |
| 3131 | DGPKK | 1 |
| 3132 | DGRRR | 1 |
| 3133 | DGVRR | 1 |
| 3134 | DMLTR | 1 |
| 2535 | DNLLR | 1 |
| 2808 | DNLSR | 1 |
| 3135 | DSLNR | 1 |
| 3136 | DTLDR | 1 |

TABLE 17-continued

ZF5
selection on G:C
change at nt 8 of core motif in CBS.
Sequences reflect position 2 to 6.

| SEQ ID NO: | Sequence | # Read |
|---|---|---|
| 371 | DTLRV | 1 |
| 3137 | DVLRK | 1 |
| 3138 | DVLRS | 1 |
| 3139 | DVLSR | 1 |
| 3140 | DVQKR | 1 |
| 3141 | EALVR | 1 |
| 2812 | EGLIR | 1 |
| 3142 | EGLKM | 1 |
| 2704 | EGLLR | 1 |
| 2891 | EGLMR | 1 |
| 3143 | EGLQC | 1 |
| 3144 | EGLRS | 1 |
| 2894 | EGLRV | 1 |
| 3145 | EGRRR | 1 |
| 2895 | EGVRR | 1 |
| 3146 | EGWS . . . | 1 |
| 2705 | ENLAR | 1 |
| 2633 | ENLSR | 1 |
| 3147 | ESLAR | 1 |
| 3148 | ETGWG . . . | 1 |
| 3149 | ETLER | 1 |
| 3150 | ETLHR | 1 |
| 3151 | ETLVR | 1 |
| 3152 | ETRRR | 1 |
| 3153 | EVLKR | 1 |
| 2814 | GAEE . . . | 1 |
| 3154 | GALAR | 1 |
| 2778 | GALNR | 1 |
| 3155 | GDLYR | 1 |
| 3156 | GDPAP . . . | 1 |
| 2642 | GGLDR | 1 |
| 2745 | GGLGR | 1 |
| 2904 | GGLQE | 1 |
| 3157 | GGQTR | 1 |
| 3158 | GGVR | 1 |
| 3159 | GHLQR | 1 |
| 3160 | GILRR | 1 |
| 3161 | GMLRR | 1 |
| 2522 | GNLDR | 1 |
| 3162 | GNLLL | 1 |
| 2517 | GNLLR | 1 |
| 2609 | GNLQR | 1 |
| 3163 | GNLVM | 1 |
| 2685 | GTLLV | 1 |
| 2192 | GTLRV | 1 |
| 3164 | GTLRW | 1 |
| 3165 | GTPHR | 1 |
| 3166 | GVLAR | 1 |
| 3167 | GVLNR | 1 |
| 3168 | GVLVR | 1 |
| 3169 | GWLSR | 1 |
| 3170 | HAEA . . . | 1 |
| 43 | HALKV | 1 |
| 3171 | HDLKR | 1 |
| 3172 | HELTR | 1 |
| 3173 | HGLRW | 1 |
| 3174 | HGMRR | 1 |
| 3175 | HILIR | 1 |
| 3176 | HLLNR | 1 |
| 2661 | HNLAR | 1 |
| 3177 | HPAP . . . | 1 |
| 2645 | HQLIR | 1 |
| 2825 | HSLAR | 1 |
| 2933 | HSLSR | 1 |
| 3178 | HTLNK | 1 |
| 3179 | HTLRA | 1 |
| 3180 | HTLRG | 1 |
| 3181 | HTLSR | 1 |
| 2709 | HVLER | 1 |
| 3182 | HWLLR | 1 |
| 2710 | IGLRR | 1 |

TABLE 17-continued

ZF5
selection on G:C
change at nt 8 of core motif in CBS.
Sequences reflect position 2 to 6.

| SEQ ID NO: | Sequence | # Read |
|---|---|---|
| 2754 | IGLTG | 1 |
| 2711 | INLTR | 1 |
| 3183 | ITLTR | 1 |
| 3184 | KGLPG | 1 |
| 3185 | MDVKG | 1 |
| 3186 | MTLIR | 1 |
| 2635 | NALRR | 1 |
| 2676 | NALVR | 1 |
| 2614 | NGLER | 1 |
| 2938 | NHLVQ | 1 |
| 2786 | NMLAR | 1 |
| 2543 | NNLAR | 1 |
| 2637 | NNLLR | 1 |
| 2787 | NSLAR | 1 |
| 2940 | NTLNR | 1 |
| 2941 | NTLQR | 1 |
| 3187 | P*MGS | 1 |
| 3188 | PALKP | 1 |
| 3189 | PGWAG | 1 |
| 3190 | PTLKR | 1 |
| 3191 | PTLRR | 1 |
|  | PWS . . . | 1 |
| 2602 | QALKR | 1 |
| 2947 | QALTR | 1 |
| 3192 | QDLAT | 1 |
| 3193 | QDLVR | 1 |
| 2728 | QGLAR | 1 |
| 2729 | QNLHR | 1 |
| 2646 | QNLQR | 1 |
| 2575 | QNLRR | 1 |
| 2841 | QNLRW | 1 |
| 3194 | QPACV | 1 |
| 3195 | QTLHR | 1 |
| 2950 | QTLQR | 1 |
| 3196 | QTLTR | 1 |
| 3197 | RGLKR | 1 |

TABLE 17-continued

ZF5
selection on G:C
change at nt 8 of core motif in CBS.
Sequences reflect position 2 to 6.

| SEQ ID NO: | Sequence | # Read |
|---|---|---|
| 3198 | RPAA . . . | 1 |
| 2336 | RTLKV | 1 |
| 3199 | SALHR | 1 |
| 1887 | SALKV | 1 |
| 2955 | SALMC | 1 |
| 2730 | SALMR | 1 |
| 3200 | SDLKS | 1 |
| 3201 | SILKV | 1 |
| 3202 | SILNR | 1 |
| 2791 | SILVR | 1 |
| 2533 | SMLAR | 1 |
| 3203 | SMLLR | 1 |
| 3204 | SMLR | 1 |
| 2524 | SNLAR | 1 |
| 3205 | SNLHR | 1 |
| 2963 | SNLQR | 1 |
| 3206 | SPLHR | 1 |
| 3207 | SSLKW | 1 |
| 3208 | STPER | 1 |
| 3209 | STQVR | 1 |
| 3210 | SVLQR | 1 |
| 3211 | SVLSR | 1 |
| 2795 | TALNR | 1 |
| 2631 | TALVR | 1 |
| 2765 | TGLDR | 1 |
| 3212 | TGLKW | 1 |
| 3213 | TGLNV | 1 |
| 3214 | TGLQC | 1 |
| 3215 | TGLRQ | 1 |
| 2977 | TGPAR | 1 |
| 3216 | TGPNR | 1 |
| 3217 | TGQRR | 1 |
| 74 | TMLRR | 1 |
| 2561 | TNLMR | 1 |
| 2526 | TNLNR | 1 |
| 3218 | TRLVR | 1 |

TABLE 17-continued

ZF5
selection on G:C
change at nt 8 of core motif in CBS.
Sequences reflect position 2 to 6.

| SEQ ID NO: | Sequence | # Read |
|---|---|---|
| 3219 | TSLIS | 1 |
| 3220 | TTLDR | 1 |
| 3221 | TTLKK | 1 |
| 3222 | TTLRT | 1 |
| 1919 | TTLRV | 1 |
| 2861 | TVLRM | 1 |
| 2985 | VALAR | 1 |
| 3223 | VALRR | 1 |
| 3224 | VGLHR | 1 |
| 3225 | VGLNR | 1 |
| 2652 | VGLQR | 1 |
| 2619 | VGLRR | 1 |
| 2990 | VGLTM | 1 |
| 2605 | VNLKR | 1 |
| 3226 | YGLAR | 1 |
| 3227 | YGLVR | 1 |
| 3228 | YILRR | 1 |

TABLE 18

ZF5
selection on G:T
change at nt 8 of core motif in CBS.
Sequences reflect position 2 to 6.

| SEQ ID NO: | Sequence | Read # |
|---|---|---|
| 50 | GGLVR | 178 |
| 2538 | AALRR | 174 |
| 2607 | GALVR | 170 |
| 2462 | TGLRR | 162 |
| 2464 | SGLRR | 158 |
| 2461 | GGLRR | 152 |
| 2463 | EGLRR | 148 |
| 2475 | AGLRR | 143 |
| 2641 | GALRR | 126 |
| 56 | HTLRR | 125 |
| 2027 | GGLKR | 117 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2700 | AALTR | 111 |
| 2473 | AGLTR | 108 |
| 2521 | GALKR | 104 |
| 2465 | AGLAR | 102 |
| 54 | HGLVR | 101 |
| 1932 | HGLKR | 99 |
| 2610 | HALAR | 97 |
| 1986 | AGLKR | 96 |
| 59 | HGLRR | 96 |
| 1985 | AALKR | 94 |
| 2466 | SGLAR | 93 |
| 66 | ATLRR | 90 |
| 2539 | ETLRR | 90 |
| 2471 | HGLAR | 90 |
| 2495 | EGLKR | 83 |
| 2477 | SGLTR | 82 |
| 2488 | HGLTR | 79 |
| 1843 | DGLRR | 77 |
| 2592 | GALTR | 75 |
| 2467 | GGLAR | 74 |
| 2483 | HALRR | 74 |
| 2523 | SALRR | 71 |
| 2486 | SGLVR | 70 |
| 2734 | TALRR | 69 |
| 3154 | GALAR | 66 |
| 2500 | TGLKR | 66 |
| 55 | GGLTR | 63 |
| 2694 | SALVR | 61 |
| 2875 | ASLRR | 57 |
| 108 | DALRR | 57 |
| 2530 | DTLRR | 52 |
| 2819 | GSLKR | 50 |
| 2748 | HALHR | 46 |
| 2568 | HSLVR | 46 |
| 2546 | AALAR | 45 |
| 2131 | SALKR | 45 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2583 | EALRR | 44 |
| 2770 | AALVR | 42 |
| 1884 | EALKR | 42 |
| 2827 | HSLRR | 42 |
| 2532 | SALAR | 42 |
| 2666 | SALTR | 42 |
| 2489 | SSLRR | 41 |
| 2654 | ATLAR | 40 |
| 1930 | HALKR | 40 |
| 2587 | NTLRR | 40 |
| 2956 | SALNR | 40 |
| 2479 | AGLQR | 39 |
| 1837 | DGLVR | 38 |
| 2502 | ETLKR | 38 |
| 49 | QALRR | 38 |
| 2678 | TALAR | 36 |
| 2857 | TTLAR | 36 |
| 2737 | TTLRR | 36 |
| 2547 | HALVR | 35 |
| 2578 | HTLAR | 35 |
| 2476 | GGLSR | 34 |
| 2738 | AALNR | 33 |
| 2470 | GGLQR | 33 |
| 2564 | SSLVR | 33 |
| 2656 | DTLNR | 31 |
| 2600 | GSLRR | 31 |
| 2586 | HTLMR | 30 |
| 2559 | SGLKR | 30 |
| 2550 | STLAR | 30 |
| 2498 | AGLSR | 29 |
| 1988 | AGLVR | 29 |
| 2509 | ASLKR | 29 |
| 2684 | GTLAR | 29 |
| 3229 | QALVR | 29 |
| 2594 | SGLIR | 29 |
| 2545 | STLSR | 29 |
| 2472 | TGLVR | 29 |
| 2468 | DGLAR | 28 |
| 2701 | DSLKR | 28 |
| 2762 | STLTR | 28 |
| 2653 | AALSR | 27 |
| 2674 | HALSR | 27 |
| 2603 | SALSR | 27 |
| 2850 | STLMR | 26 |
| 2828 | HTLNR | 25 |
| 1870 | DGLTR | 24 |
| 51 | HGLIR | 24 |
| 2628 | NTLKR | 24 |
| 2589 | TSLRR | 24 |
| 2997 | VTLRR | 24 |
| 2569 | AGLNR | 23 |
| 2721 | GALSR | 23 |
| 2630 | SSLTR | 22 |
| 2480 | AGLHR | 21 |
| 2778 | GALNR | 21 |
| 2753 | HTLGR | 21 |
| 2593 | QTLRR | 21 |
| 53 | TGLTR | 21 |
| 2717 | AALQR | 20 |
| 2562 | GTLTR | 20 |
| 2643 | HGLMR | 20 |
| 2617 | TALKR | 20 |
| 2799 | ASLQR | 19 |
| 2739 | ATLVR | 19 |
| 1831 | DALKR | 19 |
| 2634 | ESLRR | 19 |
| 2659 | GGLNR | 19 |
| 2622 | ATLTR | 18 |
| 2528 | GGLIR | 18 |
| 2660 | GSLTR | 18 |
| 2554 | GTLKR | 18 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2707 | GTLQR | 18 |
| 2636 | NGLKR | 18 |
| 2667 | SDLKR | 18 |
| 2698 | STLVR | 18 |
| 2584 | GTLRR | 17 |
| 2525 | SGLLR | 17 |
| 2493 | AGLIR | 16 |
| 2800 | ASLVR | 16 |
| 2818 | GSLAR | 16 |
| 2934 | HTLHR | 16 |
| 2549 | SGLNR | 16 |
| 2474 | SGLSR | 16 |
| 1871 | DALVR | 15 |
| 2916 | GSLVR | 15 |
| 2782 | HGLHR | 15 |
| 2878 | ATLER | 14 |
| 3098 | HSLQR | 14 |
| 2501 | SGLQR | 14 |
| 2519 | TGLIR | 14 |
| 2516 | TGLSR | 14 |
| 2858 | TTLGR | 14 |
| 2767 | TTLVR | 14 |
| 2995 | VTLKR | 14 |
| 2772 | ATLSR | 13 |
| 2702 | DSLRR | 13 |
| 2759 | SALIR | 13 |
| 2631 | TALVR | 13 |
| 2736 | TTLLR | 13 |
| 2864 | AALLR | 12 |
| 3230 | HALTR | 12 |
| 2616 | QGLVR | 12 |
| 2469 | TGLAR | 12 |
| 2880 | ATLLR | 11 |
| 2563 | DGLNR | 11 |
| 2626 | GTLVR | 11 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2602 | QALKR | 11 |
| 3231 | SALLR | 11 |
| 3232 | SSLHR | 11 |
| 2967 | STLNR | 11 |
| 2492 | TGLQR | 11 |
| 2590 | TTLQR | 11 |
| 2876 | ASLTR | 10 |
| 109 | DGLKR | 10 |
| 2756 | NSLRR | 10 |
| 2692 | QSLKR | 10 |
| 2537 | SGLMR | 10 |
| 2849 | STLHR | 10 |
| 2638 | STLRR | 10 |
| 3113 | AALHR | 9 |
| 2879 | ATLIR | 9 |
| 3017 | ATLNR | 9 |
| 2672 | DTLAR | 9 |
| 2566 | DTLKR | 9 |
| 2484 | HGLQR | 9 |
| 2933 | HSLSR | 9 |
| 2943 | PALKR | 9 |
| 2964 | SSLIR | 9 |
| 2764 | TALTR | 9 |
| 2588 | TGLHR | 9 |
| 2881 | ATLQR | 8 |
| 3007 | HTLIR | 8 |
| 2829 | HTLTR | 8 |
| 2941 | NTLQR | 8 |
| 2579 | QGLKR | 8 |
| 2699 | SVLKR | 8 |
| 3047 | TSLNR | 8 |
| 3233 | AALIR | 7 |
| 2865 | AALMR | 7 |
| 2999 | DALTR | 7 |
| 2719 | DTLQR | 7 |
| 3234 | GSLHR | 7 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2781 | GSLQR | 7 |
| 2548 | HGLSR | 7 |
| 2478 | NGLVR | 7 |
| 2965 | SSLKR | 7 |
| 2848 | STLER | 7 |
| 2795 | TALNR | 7 |
| 48 | ATLKR | 6 |
| 2802 | AVLKR | 6 |
| 3038 | ETLAR | 6 |
| 2503 | HGLLR | 6 |
| 2830 | HTLVR | 6 |
| 2784 | HVLKR | 6 |
| 3235 | NALQR | 6 |
| 2485 | NGLRR | 6 |
| 3236 | NSLVR | 6 |
| 2580 | SGLER | 6 |
| 2514 | SGLHR | 6 |
| 2860 | TTLKR | 6 |
| 3237 | AALER | 5 |
| 3238 | AALGR | 5 |
| 3025 | ATLGR | 5 |
| 2598 | EGLNR | 5 |
| 2904 | GGLQE | 5 |
| 70 | GNLTR | 5 |
| 2086 | NALKR | 5 |
| 2788 | NTLAR | 5 |
| 2843 | QTLKR | 5 |
| 2950 | QTLQR | 5 |
| 2505 | TGLMR | 5 |
| 2515 | TGLNR | 5 |
| 2980 | TSLAR | 5 |
| 2743 | DGLQR | 4 |
| 2703 | DTLMR | 4 |
| 2777 | EGLVR | 4 |
| 2745 | GGLGR | 4 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2536 | GGLMR | 4 |
| 3239 | GSLIR | 4 |
| 3240 | GSLNR | 4 |
| 2673 | HALLR | 4 |
| 2783 | HTLKR | 4 |
| 46 | HTLKV | 4 |
| 2938 | NHLVQ | 4 |
| 2510 | QGLRR | 4 |
| 3241 | QVLKR | 4 |
| 3199 | SALHR | 4 |
| 2845 | SSLAR | 4 |
| 2668 | STLGR | 4 |
| 3018 | STLIR | 4 |
| 2966 | STLLR | 4 |
| 3242 | TALQR | 4 |
| 3073 | TSLMR | 4 |
| 3243 | AALDR | 3 |
| 2527 | AGLLR | 3 |
| 2542 | ANLAR | 3 |
| 69 | ANLRR | 3 |
| 3244 | ASLSR | 3 |
| 3012 | ATLHR | 3 |
| 2570 | DALAR | 3 |
| 2804 | DALQR | 3 |
| 2499 | DGLIR | 3 |
| 2553 | DGLSR | 3 |
| 2520 | DMLRR | 3 |
| 2497 | EGLAR | 3 |
| 2490 | EGLTR | 3 |
| 2658 | ESLKR | 3 |
| 2491 | GGLER | 3 |
| 2625 | GGLLR | 3 |
| 138 | GNLAR | 3 |
| 117 | GNLVR | 3 |
| 3245 | GSLSR | 3 |
| 3246 | HALQR | 3 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2577 | HNLTR | 3 |
| 3085 | HSLKR | 3 |
| 2613 | HTLQR | 3 |
| 2832 | ITLKR | 3 |
| 2833 | MTLKR | 3 |
| 2787 | NSLAR | 3 |
| 3247 | NSLSR | 3 |
| 2940 | NTLNR | 3 |
| 2947 | QALTR | 3 |
| 2573 | QGLTR | 3 |
| 3195 | QTLHR | 3 |
| 3248 | QTLVR | 3 |
| 2730 | SALMR | 3 |
| 2496 | SNLLR | 3 |
| 2604 | SSLGR | 3 |
| 2847 | STLDR | 3 |
| 2970 | SVLRR | 3 |
| 2507 | TGLLR | 3 |
| 2561 | TNLMR | 3 |
| 68 | TNLRR | 3 |
| 3249 | TSLER | 3 |
| 2618 | TTLMR | 3 |
| 2534 | VGLKR | 3 |
| 2718 | AGLDR | 2 |
| 2669 | AGLER | 2 |
| 2797 | AGLGR | 2 |
| 3250 | ASLMR | 2 |
| 3251 | ASLNR | 2 |
| 2552 | DGLDR | 2 |
| 2529 | DGLHR | 2 |
| 2591 | DNLKR | 2 |
| 2535 | DNLLR | 2 |
| 2623 | DNLRR | 2 |
| 2506 | DNLVR | 2 |
| 2683 | DSLAR | 2 |
| 3030 | DTLLR | 2 |
| 2809 | DTLSR | 2 |
| 2810 | DTLTR | 2 |
| 2720 | DVLKR | 2 |
| 2811 | DVLRR | 2 |
| 2890 | EALTR | 2 |
| 3043 | ETLQR | 2 |
| 3252 | GALDR | 2 |
| 2779 | GDLKR | 2 |
| 2780 | GDLTR | 2 |
| 3253 | GGPRR | 2 |
| 2917 | GTLER | 2 |
| 3254 | HALNR | 2 |
| 2820 | HDLRR | 2 |
| 2687 | HGLDR | 2 |
| 2585 | HGLGR | 2 |
| 2821 | HGLNR | 2 |
| 2482 | HNLLR | 2 |
| 2826 | HSLHR | 2 |
| 3255 | MPLTR | 2 |
| 2834 | NALHR | 2 |
| 2540 | NGLAR | 2 |
| 2572 | NGLIR | 2 |
| 2755 | NGLLR | 2 |
| 2504 | NGLQR | 2 |
| 2512 | NGLTR | 2 |
| 2837 | NTLHR | 2 |
| 2939 | NTLIR | 2 |
| 2942 | NVLKR | 2 |
| 2948 | QDLIR | 2 |
| 2838 | QDLKR | 2 |
| 2842 | QSLRR | 2 |
| 3004 | SILKR | 2 |
| 2556 | SMLRR | 2 |
| 2793 | SSLQR | 2 |
| 2697 | STLQR | 2 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2971 | TALER | 2 |
| 2851 | TALGR | 2 |
| 2157 | TGLRV | 2 |
| 2978 | TMLKR | 2 |
| 2511 | TNLVR | 2 |
| 2715 | TSLHR | 2 |
| 3019 | TTLSR | 2 |
| 2651 | TTLTR | 2 |
| 3256 | AALTG | 1 |
| 2866 | AAPER | 1 |
| 58 | ADLKR | 1 |
| 2868 | AGLAW | 1 |
| 3257 | AGVIR | 1 |
| 3258 | AGVTR | 1 |
| 71 | AMLKR | 1 |
| 2621 | ANLNR | 1 |
| 3090 | ASLAR | 1 |
| 3259 | ASLRG | 1 |
| 2801 | ATLMR | 1 |
| 3260 | ATLRM | 1 |
| 3261 | ATPRR | 1 |
| 3262 | AVLAR | 1 |
| 2882 | AVLRR | 1 |
| 3263 | AVLVR | 1 |
| 2803 | DALNR | 1 |
| 2596 | DGLGR | 1 |
| 1833 | DGLKK | 1 |
| 1853 | DGLRK | 1 |
| 3129 | DGLWR | 1 |
| 3264 | DGPAA . . . | 1 |
| 2640 | DMLKR | 1 |
| 2597 | DSLQR | 1 |
| 2776 | DTLVR | 1 |
| 2014 | DVLKK | 1 |
| 3265 | EALHR | 1 |

TABLE 18-continued

ZF5
selection on G:T
change at nt 8 of core motif in CBS.
Sequences reflect position 2 to 6.

| SEQ ID NO: | Sequence | Read # |
|---|---|---|
| 3266 | EALSR | 1 |
| 3095 | EGLHR | 1 |
| 2891 | EGLMR | 1 |
| 3267 | EGLRG | 1 |
| 2894 | EGLRV | 1 |
| 2705 | ENLAR | 1 |
| 2633 | ENLSR | 1 |
| 2814 | GAEE . . . | 1 |
| 3268 | GALER | 1 |
| 3269 | GALGK | 1 |
| 3270 | GALIR | 1 |
| 3271 | GALKV | 1 |
| 3272 | GALMR | 1 |
| 2815 | GALQR | 1 |
| 3273 | GAPRR | 1 |
| 3003 | GDLNR | 1 |
| 2817 | GDLVR | 1 |
| 2642 | GGLDR | 1 |
| 2571 | GGLHR | 1 |
| 3274 | GGPAR | 1 |
| 3275 | GGPVR | 1 |
| 3276 | GGQVR | 1 |
| 3277 | GGVAR | 1 |
| 3278 | GGWP . . . | 1 |
| 2913 | GMLAR | 1 |
| 2481 | GNLER | 1 |
| 139 | GNLMR | 1 |
| 2609 | GNLQR | 1 |
| 3279 | GSLRV | 1 |
| 2918 | GTLGR | 1 |
| 2919 | GTLHR | 1 |
| 3081 | GTLMR | 1 |
| 2747 | GTLNR | 1 |
| 2723 | GTLSR | 1 |
| 3280 | HAAQ . . . | 1 |
| 3281 | HALAS | 1 |

TABLE 18-continued

ZF5
selection on G:T
change at nt 8 of core motif in CBS.
Sequences reflect position 2 to 6.

| SEQ ID NO: | Sequence | Read # |
|---|---|---|
| 3282 | HALER | 1 |
| 3283 | HALVH | 1 |
| 3284 | HAMRR | 1 |
| 3285 | HAQHR | 1 |
| 3286 | HGLTL | 1 |
| 3287 | HGLVM | 1 |
| 2531 | HLLKR | 1 |
| 2661 | HNLAR | 1 |
| 2557 | HNLHR | 1 |
| 3050 | HNLKR | 1 |
| 2627 | HNLSR | 1 |
| 2644 | HNLVR | 1 |
| 3177 | HPAP . . . | 1 |
| 2645 | HQLIR | 1 |
| 3288 | HSLGR | 1 |
| 1936 | HTLRV | 1 |
| 2935 | HVLAR | 1 |
| 2710 | IGLRR | 1 |
| 2754 | IGLTG | 1 |
| 2711 | INLTR | 1 |
| 3184 | KGLPG | 1 |
| 3289 | MPLQR | 1 |
| 2937 | NALAR | 1 |
| 2663 | NGLHR | 1 |
| 2615 | NGLMR | 1 |
| 2555 | NGLSR | 1 |
| 2664 | NMLKR | 1 |
| 2543 | NNLAR | 1 |
| 2637 | NNLLR | 1 |
| 3006 | NTLTR | 1 |
|  | PWS . . . | 1 |
| 3290 | QAPWP . . . | 1 |
| 3023 | QDLRR | 1 |
| 2728 | QGLAR | 1 |
| 2574 | QMLKR | 1 |
| 2729 | QNLHR | 1 |

TABLE 18-continued

ZF5
selection on G:T
change at nt 8 of core motif in CBS.
Sequences reflect position 2 to 6.

| SEQ ID NO: | Sequence | Read # |
|---|---|---|
| 2646 | QNLQR | 1 |
| 2841 | QNLRW | 1 |
| 3104 | QTLSR | 1 |
| 3291 | RGLQR | 1 |
| 2629 | SALER | 1 |
| 2693 | SALGR | 1 |
| 2955 | SALMC | 1 |
| 3292 | SALQR | 1 |
| 3293 | SAQR . . . | 1 |
| 3294 | SARVR | 1 |
| 2957 | SDLAR | 1 |
| 3295 | SDLNR | 1 |
| 2958 | SDLQR | 1 |
| 2959 | SDLRR | 1 |
| 3105 | SELRR | 1 |
| 3296 | SGADA . . . | 1 |
| 3297 | SGLR . . . | 1 |
| 3298 | SGLVC | 1 |
| 3299 | SGPDP . . . | 1 |
| 2533 | SMLAR | 1 |
| 2487 | SNLDR | 1 |
| 2963 | SNLQR | 1 |
| 2544 | SNLSR | 1 |
| 2696 | SQLRR | 1 |
| 3300 | SSLPR | 1 |
| 2302 | STLKT | 1 |
| 2968 | STLRK | 1 |
| 3301 | STPSR | 1 |
| 2733 | SVLTR | 1 |
| 3302 | TALLR | 1 |
| 3303 | TAPTR | 1 |
| 2973 | TDLAR | 1 |
| 2974 | TDLRR | 1 |
| 3304 | TGLIK | 1 |
| 2977 | TGPAR | 1 |

TABLE 18-continued

ZF5  
selection on G:T  
change at nt 8 of core motif in CBS.  
Sequences reflect position 2 to 6.

| SEQ ID NO: | Sequence | Read # |
|---|---|---|
| 3217 | TGQRR | 1 |
| 2595 | TNLKR | 1 |
| 2526 | TNLNR | 1 |
| 2766 | TSLKR | 1 |
| 2983 | TSLQR | 1 |
| 2859 | TTLIR | 1 |
| 1849 | TTLKV | 1 |
| 2681 | TTLNR | 1 |
| 2861 | TVLRM | 1 |
| 3305 | TWLRR | 1 |
| 2985 | VALAR | 1 |
| 3306 | VALQR | 1 |
| 2652 | VGLQR | 1 |
| 2990 | VGLTM | 1 |
| 2605 | VNLKR | 1 |
| 3307 | VSLKR | 1 |
| 3308 | VSLRR | 1 |
| 3112 | VTLAR | 1 |
| 2994 | VTLGR | 1 |

TABLE 19

ZF4  
selection on G:T  
change at nt 10 of core motif in CBS.  
Sequences reflect position 2 to 6.

| SEQ ID NO: | Sequence | Read # |
|---|---|---|
| 60 | AHLRK | 4967 |
| 158 | GHLKK | 1446 |
| 3309 | THLRA | 1429 |
| 1386 | EHLRR | 1293 |
| 162 | GHLRK | 1082 |
| 3310 | HHLTK | 876 |
| 63 | AKLRI | 867 |
| 61 | AKLRV | 641 |
| 3311 | AKLRL | 625 |
| 3312 | AKLKI | 599 |

TABLE 19-continued

ZF4  
selection on G:T  
change at nt 10 of core motif in CBS.  
Sequences reflect position 2 to 6.

| SEQ ID NO: | Sequence | Read # |
|---|---|---|
| 3313 | SHLRK | 566 |
| 159 | AHLKK | 560 |
| 163 | THLKK | 496 |
| 160 | TKLRL | 486 |
| 92 | SKLRL | 475 |
| 2137 | SKLKV | 466 |
| 161 | TKLKL | 466 |
| 3314 | QHLRK | 457 |
| 3315 | AKLKL | 443 |
| 3316 | GHLVK | 419 |
| 3317 | GKLKI | 302 |
| 3318 | THLRK | 268 |
| 3319 | AKLKV | 258 |
| 106 | GKLRI | 246 |
| 3320 | GKLRL | 224 |
| 3321 | GHLRL | 213 |
| 3322 | TKLKI | 199 |
| 3323 | RSLGL | 178 |
| 90 | AHLRV | 177 |
| 3324 | AHLRL | 153 |
| 3325 | TKLRV | 152 |
| 3326 | SKLKI | 146 |
| 3327 | SHLVG | 132 |
| 3328 | GKLKL | 116 |
| 64 | TKLKV | 108 |
| 3329 | THLRT | 107 |
| 3330 | GHLRR | 102 |
|  | *R . . . | 92 |
| 3331 | SHLRL | 90 |
| 65 | SKLRV | 80 |
| 3332 | GALV . . . | 79 |
| 3333 | GHLKM | 75 |
| 3334 | SKLRI | 74 |
| 3335 | GILS . . . | 71 |
| 3336 | SK*VL | 63 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3337 | SKLVL | 62 |
|  | TR . . . | 61 |
| 3338 | IRLGV | 59 |
| 3339 | MALGL | 58 |
| 3340 | EHLRK | 54 |
| 3341 | GHLRM | 54 |
| 1407 | EHLKR | 50 |
| 3342 | ITLM . . . | 48 |
| 3343 | AHLVK | 40 |
| 3344 | THLRL | 40 |
| 3345 | GKLKV | 38 |
| 3346 | GHLKL | 34 |
| 3347 | AHLRR | 32 |
| 3348 | GHLIK | 30 |
| 3349 | EHLVR | 28 |
| 3350 | GKLRV | 27 |
| 3351 | TALSM | 26 |
| 3352 | EHLQR | 25 |
| 3353 | EKLKV | 25 |
| 3354 | QHLVK | 25 |
| 3355 | TKLNL | 25 |
| 3356 | GHLRA | 23 |
| 3357 | GRLPK | 21 |
|  | NGR . . . | 21 |
| 3358 | SKLKL | 21 |
| 3359 | THLTK | 21 |
| 3360 | RLLSG | 20 |
| 3361 | TKLRI | 19 |
| 3362 | AHLRI | 18 |
| 409 | GHLKV | 16 |
| 3363 | GHLRV | 16 |
| 3364 | GLLPG | 16 |
| 3365 | AKLRT | 14 |
| 3366 | RHLRV | 14 |
| 3367 | AALRK | 11 |
| 3368 | AHLHK | 11 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3369 | GHLTK | 11 |
| 3370 | QHLRR | 11 |
| 3371 | RSHS . . . | 11 |
| 3372 | SHLNK | 11 |
| 3373 | AHLQK | 10 |
| 3374 | GHLMK | 10 |
| 3375 | SKLRT | 10 |
| 287 | AHLKV | 9 |
| 3376 | AHLRA | 9 |
| 370 | AHLRT | 9 |
| 3377 | EHLRL | 9 |
| 3378 | GHLKI | 9 |
| 3379 | SHLKL | 9 |
| 3380 | EHLKK | 8 |
| 3381 | GHLRT | 8 |
| 3382 | GKLKM | 8 |
| 3383 | HHLKK | 8 |
| 3384 | SKLTI | 8 |
| 3385 | THEKP . . . | 8 |
|  | *G . . . | 7 |
| 3386 | AKLIL | 7 |
| 3387 | AKLTI | 7 |
| 3388 | HALAA | 7 |
| 3389 | TKLQV | 7 |
| 3390 | AKLRM | 6 |
| 3391 | EHLRI | 6 |
| 3392 | GHLAK | 6 |
| 3393 | GHLKR | 6 |
| 3394 | GKLTL | 6 |
| 3395 | SHLKK | 6 |
| 3396 | SHLRR | 6 |
| 3397 | AILKA | 5 |
| 89 | AKLRK | 5 |
| 3398 | AKLTL | 5 |
| 3399 | ASLTG | 5 |
| 201 | EHLRV | 5 |

TABLE 19-continued

ZF4 selection on G:T change at nt 10 of core motif in CBS. Sequences reflect position 2 to 6.

| SEQ ID NO: | Sequence | Read # |
|---|---|---|
| 3400 | EVLTM | 5 |
| 3401 | GHLKT | 5 |
| 3402 | NGRS . . . | 5 |
| 3403 | THLRR | 5 |
| 3404 | AHLKL | 4 |
| 3405 | GALVH | 4 |
| 3406 | GKLVL | 4 |
| 3407 | NGRSPV . . . | 4 |
| 3408 | QALSI | 4 |
| 3409 | SHLRT | 4 |
|  | TRS . . . | 4 |
| 3410 | AALRL | 3 |
| 3411 | AHLMK | 3 |
| 439 | AHLRE | 3 |
| 3412 | AHLRQ | 3 |
| 3413 | AKLNL | 3 |
| 3414 | AKLRA | 3 |
| 3415 | APLRK | 3 |
| 186 | EKLRI | 3 |
| 3416 | GALMG | 3 |
| 3417 | GALTG | 3 |
| 3418 | GHLRG | 3 |
| 3419 | GHLTL | 3 |
| 3420 | GKLRK | 3 |
| 3421 | GKLTV | 3 |
| 187 | GKLVT | 3 |
| 3422 | HHLRK | 3 |
| 3423 | MGLVG | 3 |
| 1848 | SHLKV | 3 |
| 3424 | SHLRI | 3 |
| 3425 | SKLIL | 3 |
| 3426 | SKLMV | 3 |
| 3427 | SLLAG | 3 |
| 3428 | THLKI | 3 |
| 3429 | THLQK | 3 |
| 3430 | VPLAG | 3 |

TABLE 19-continued

ZF4 selection on G:T change at nt 10 of core motif in CBS. Sequences reflect position 2 to 6.

| SEQ ID NO: | Sequence | Read # |
|---|---|---|
| 3431 | AGLLG | 2 |
| 3432 | AHLKM | 2 |
| 3433 | AHLRN | 2 |
| 3434 | AHLTK | 2 |
| 3435 | AKLIV | 2 |
| 3436 | AKLKA | 2 |
| 88 | AKLKK | 2 |
| 3437 | AKLTV | 2 |
| 3438 | AKLVL | 2 |
| 3439 | AKSRI | 2 |
| 3440 | AMLMQ | 2 |
| 3441 | AQLRI | 2 |
| 3442 | DALR . . . | 2 |
| 419 | EHLRA | 2 |
| 313 | EHLRT | 2 |
| 3443 | EKLKL | 2 |
| 3444 | GGLQK | 2 |
| 3445 | GGLTM | 2 |
|  | GH*R . . . | 2 |
| 3446 | GHLLR | 2 |
| 3447 | GHLRI | 2 |
| 3448 | GHLVG | 2 |
| 3449 | GHLVR | 2 |
| 3450 | GKLNL | 2 |
| 2912 | GKLRR | 2 |
| 3451 | GKLVP | 2 |
| 3452 | GLLGL | 2 |
| 3453 | GNLGM | 2 |
| 3454 | GVLQK | 2 |
| 3455 | HGLLP | 2 |
| 2043 | HHLRV | 2 |
| 3456 | HLLEN | 2 |
| 3457 | IGLQR | 2 |
| 3458 | KTLGV | 2 |
| 3459 | LSLLK | 2 |
| 3460 | MRLGE | 2 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3461 | NSLTR | 2 |
| 3462 | NVLNK | 2 |
| 3463 | PHLRK | 2 |
| 3464 | PLLMP | 2 |
| 3465 | PRLRH | 2 |
| 3466 | QKLHL | 2 |
| 3467 | QKLNL | 2 |
| 3468 | SHLRV | 2 |
| 3469 | SKLHL | 2 |
| 3470 | SKLKR | 2 |
| 3471 | SKLNL | 2 |
| 3472 | SPLAE | 2 |
| 3473 | SVLML | 2 |
|  | TH*R . . . | 2 |
| 2448 | THLKL | 2 |
| 3474 | THLRV | 2 |
| 3475 | TKLIL | 2 |
| 3476 | TKLMV | 2 |
| 3477 | TPLNI | 2 |
| 3478 | TRLQK | 2 |
| 3024 | TSLTR | 2 |
| 3479 | VGLGQ | 2 |
| 3480 | VHLRK | 2 |
| 3481 | AALES | 1 |
| 3482 | AALRI | 1 |
| 3483 | ADLRK | 1 |
| 3484 | AELLG | 1 |
| 3485 | AELRI | 1 |
| 3486 | AGLAA | 1 |
| 1986 | AGLKR | 1 |
| 3487 | AGLMD | 1 |
| 3488 | AHLGL | 1 |
| 3489 | AHLK . . . | 1 |
| 3490 | AHLKA | 1 |
| 3491 | AHLKI | 1 |
| 438 | AHLKT | 1 |
| 3492 | AHLNK | 1 |
| 3493 | AHLR . . . | 1 |
| 3494 | AHLSK | 1 |
| 3495 | AHLSP | 1 |
| 214 | AHLTV | 1 |
| 3496 | AHLWK | 1 |
| 3497 | AKFKI | 1 |
| 3498 | AKIKH | 1 |
| 3499 | AKIRI | 1 |
| 3500 | AKIRL | 1 |
| 3501 | AKIRV | 1 |
| 3502 | AKLHT | 1 |
| 3503 | AKLKE | 1 |
| 3504 | AKLKG | 1 |
| 3505 | AKLKM | 1 |
| 3506 | AKLMN | 1 |
| 3507 | AKLNI | 1 |
| 3508 | AKLQL | 1 |
| 3509 | AKLRG | 1 |
| 3510 | AKLRR | 1 |
| 3511 | AKLSM | 1 |
| 3512 | AKSRV | 1 |
| 3513 | AKVKL | 1 |
| 3514 | AKVRI | 1 |
| 3515 | ALLMA | 1 |
| 3516 | ALLRR | 1 |
| 3517 | AMLIM | 1 |
| 3518 | AMLKI | 1 |
| 3519 | AMLRG | 1 |
| 3520 | AMLRL | 1 |
| 3521 | ANLSN | 1 |
| 3522 | ANVAQ | 1 |
| 3523 | APLKK | 1 |
| 3524 | AQFRK | 1 |
| 3525 | AQLVD | 1 |
| 3526 | ARLAG | 1 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3527 | ARLGT | 1 |
| 3528 | ARLRA | 1 |
| 3529 | ARLRK | 1 |
| 3530 | ASLRM | 1 |
| 3531 | ATLKL | 1 |
| 3532 | ATLRV | 1 |
| 3533 | C*LKI | 1 |
| 3534 | DELMR | 1 |
| 3535 | DELRV | 1 |
| 3536 | DGLES | 1 |
| 2005 | DGLLR | 1 |
| 3537 | DGLMD | 1 |
| 3538 | DGLVG | 1 |
| 3539 | DHLKK | 1 |
| 3540 | DHLRK | 1 |
| 3541 | DHLRR | 1 |
| 3542 | DKLRK | 1 |
| 3543 | DLLGV | 1 |
| 3544 | DLLLN | 1 |
| 3545 | DNLRE | 1 |
| 3546 | DPLAR | 1 |
| 3547 | DSLGE | 1 |
| 3548 | EALMA | 1 |
| 3549 | EDLVK | 1 |
| 3550 | EELGL | 1 |
| 3551 | EELMM | 1 |
| 3267 | EGLRG | 1 |
| 3552 | EGLVE | 1 |
| 3553 | EHLG . . . | 1 |
| 3554 | EHLHK | 1 |
| 3555 | EHLKL | 1 |
| 3556 | EHLKM | 1 |
| 2016 | EHLRQ | 1 |
| 3557 | EHLRS | 1 |
| 3558 | EHLSE | 1 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3559 | EHLSR | 1 |
| 3560 | EHLTK | 1 |
| 3561 | EHLVK | 1 |
| 3562 | EQLGP | 1 |
| 3563 | ERLAA | 1 |
| 3564 | ERLGR | 1 |
| 1893 | ERLRR | 1 |
| 3565 | ESLMA | 1 |
| 3566 | ETLSH | 1 |
| 3567 | EVLGI | 1 |
| 3568 | FFLRV | 1 |
| 3569 | GALGR | 1 |
| 3570 | GALIM | 1 |
| 3571 | GDLSG | 1 |
| 3572 | GGLDL | 1 |
| 3573 | GGLDQ | 1 |
| 1957 | GGLKV | 1 |
| 3574 | GGLNM | 1 |
| 3575 | GGLPE | 1 |
| 2295 | GGLVV | 1 |
| 3576 | GHFKT | 1 |
| 3577 | GHFQN | 1 |
| 3578 | GHLK . . . | 1 |
| 3579 | GHLMN | 1 |
| 3580 | GHLMV | 1 |
| 3159 | GHLQR | 1 |
| 3581 | GHLR . . . | 1 |
| 3582 | GILAG | 1 |
| 3583 | GKLHE | 1 |
| 3584 | GKLKA | 1 |
| 3585 | GKLKF | 1 |
| 3586 | GKLKT | 1 |
| 3587 | GKLR . . . | 1 |
| 3588 | GKLRA | 1 |
| 3589 | GKLRM | 1 |
| 3590 | GKLVA | 1 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3591 | GKLVV | 1 |
| 3592 | GLLGE | 1 |
| 3593 | GLLLD | 1 |
| 3594 | GLLMG | 1 |
| 3595 | GLLRG | 1 |
| 3596 | GMLGG | 1 |
| 3597 | GPLGV | 1 |
| 3598 | GPLRV | 1 |
| 3599 | GRLKI | 1 |
| 3600 | GRLKK | 1 |
| 3601 | GSLST | 1 |
| 3602 | GSLVK | 1 |
| 2554 | GTLKR | 1 |
| 3603 | GVLAG | 1 |
| 3604 | GVLLV | 1 |
| 3605 | GVLS . . . | 1 |
| 3606 | GYLRK | 1 |
| 3607 | HALRT | 1 |
| 3608 | HALVN | 1 |
| 3609 | HGLTG | 1 |
| 3610 | HHLAK | 1 |
| 3611 | HHLRR | 1 |
| 3612 | HIRS . . . | 1 |
| 3613 | HTHEK | 1 |
| 3614 | IELVQ | 1 |
| 3615 | IGLGL | 1 |
| 3616 | IKLRL | 1 |
| 3617 | IMLRE | 1 |
| 3618 | IMLVE | 1 |
| 3619 | IPLGD | 1 |
| 3620 | IQLRK | 1 |
| 3621 | IRLG . . . | 1 |
| 3622 | IRLGG | 1 |
| 3623 | IRLVV | 1 |
| 3624 | IVLAA | 1 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3625 | KHLRA | 1 |
| 3626 | KHLRL | 1 |
| 3627 | KILPE | 1 |
| 3628 | KKLLE | 1 |
| 3629 | KMLPP | 1 |
| 3630 | KNLIK | 1 |
| 3631 | KSLMP | 1 |
| 3632 | LALGG | 1 |
| 3633 | LGLGA | 1 |
| 3634 | LGLVG | 1 |
| 3635 | LHLTK | 1 |
|  | LQ . . . | 1 |
| 3636 | LRLIG | 1 |
|  | LTE . . . | 1 |
| 3637 | LTLQR | 1 |
| 3638 | LVLRR | 1 |
| 3639 | MA*SHMK | 1 |
| 3640 | MALRL | 1 |
| 3641 | MALTR | 1 |
| 3642 | MGLDP | 1 |
| 3643 | MGLGE | 1 |
| 3644 | MGLQN | 1 |
| 3645 | MHLRM | 1 |
| 3646 | MKLEQ | 1 |
| 3647 | MLLRN | 1 |
| 3648 | MLLSH | 1 |
| 3649 | MLLVN | 1 |
| 3650 | MPLRA | 1 |
| 3651 | MQLGG | 1 |
| 3652 | MRLAR | 1 |
| 3653 | MRLMG | 1 |
| 3654 | MRLVG | 1 |
| 3655 | MSLER | 1 |
| 3656 | MTLPL | 1 |
| 3657 | MTLSD | 1 |
| 3658 | MVLAG | 1 |
|  | NG . . . | 1 |

TABLE 19-continued

ZF4 selection on G:T change at nt 10 of core motif in CBS. Sequences reflect position 2 to 6.

| SEQ ID NO: | Sequence | Read # |
|---|---|---|
| 2615 | NGLMR | 1 |
| 2504 | NGLQR | 1 |
| 3659 | NKLRL | 1 |
| 3660 | NLAH | 1 |
| 3661 | NLLPT | 1 |
| 3662 | NRLES | 1 |
| 3663 | NRLGG | 1 |
| 3664 | NTLPK | 1 |
| 3665 | PGLHG | 1 |
| 3666 | PGLRA | 1 |
| 3667 | PHFTK | 1 |
| 3668 | PILLQ | 1 |
| 3669 | PKLGL | 1 |
| 3670 | PLLKS | 1 |
| 3671 | PQLTG | 1 |
| 3672 | PREAM | 1 |
| 3673 | PTLQR | 1 |
| 3674 | QELGR | 1 |
| 3675 | QGLPV | 1 |
| 3676 | QHLKK | 1 |
| 3677 | QHLQR | 1 |
| 3678 | QHLR . . . | 1 |
| 3679 | QHLRI | 1 |
| 3680 | QHLRL | 1 |
| 3681 | QHLTK | 1 |
| 3682 | QILLH | 1 |
| 3683 | QKLRI | 1 |
| 3684 | QNLHK | 1 |
| 3685 | QPLIK | 1 |
| 3686 | QQVTA . . . | 1 |
| 3687 | QTLAE | 1 |
| 3688 | QVTLA | 1 |
| 3689 | RALSA | 1 |
|  | RGL . . . | 1 |
| 3690 | RGLGA | 1 |
| 3691 | RGLTA | 1 |
| 2953 | RGLVR | 1 |
| 3692 | RGLVV | 1 |
| 3693 | RHLRA | 1 |
| 3694 | RHLRE | 1 |
| 3695 | RHLRM | 1 |
| 3696 | RHLRR | 1 |
| 3697 | RILPR | 1 |
| 3698 | RKLIV | 1 |
| 3699 | RKLKL | 1 |
| 3700 | RLLGA | 1 |
| 3701 | RLLMP | 1 |
| 3702 | RLLRR | 1 |
| 3703 | RMLVP | 1 |
| 3704 | RRLEG | 1 |
| 3705 | RRLVN | 1 |
| 3706 | RTLML | 1 |
| 3707 | RTLTQ | 1 |
| 3708 | SDLHV | 1 |
| 3709 | SDLRK | 1 |
| 2581 | SGLGR | 1 |
| 3710 | SGLLV | 1 |
| 2486 | SGLVR | 1 |
| 3711 | SHLKM | 1 |
| 3712 | SHLRA | 1 |
| 3713 | SHLRE | 1 |
| 3714 | SHLRG | 1 |
| 3715 | SHLTK | 1 |
| 3716 | SHLTM | 1 |
| 3717 | SHLV . . . | 1 |
| 3718 | SHLVK | 1 |
| 3719 | SKIRL | 1 |
| 3720 | SKLEG | 1 |
| 3721 | SKLGA | 1 |
| 3722 | SKLKG | 1 |
| 2191 | SKLRM | 1 |
| 3723 | SKLRN | 1 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3724 | SKLRR | 1 |
| 3725 | SLLEE | 1 |
| 3726 | SLLGT | 1 |
| 3727 | SLLNG | 1 |
| 2138 | SQLKV | 1 |
| 3728 | SQLLE | 1 |
| 3729 | SRLMA | 1 |
| 3730 | STLLM | 1 |
| 3731 | STLVG | 1 |
| 3732 | TALRG | 1 |
|  | TG . . . | 1 |
| 2469 | TGLAR | 1 |
| 3733 | TGLGL | 1 |
| 3734 | TGLLK | 1 |
| 2157 | TGLRV | 1 |
| 3735 | TGLVD | 1 |
| 3385 | THEKP | 1 |
| 3736 | THFRT | 1 |
| 3737 | THIR . . . | 1 |
| 3738 | THLAR | 1 |
| 2449 | THLKQ | 1 |
| 3739 | THLLK | 1 |
| 3740 | THLMK | 1 |
| 331 | THLRP | 1 |
| 3741 | THLVK | 1 |
| 3742 | THMK | 1 |
| 3743 | THVKK | 1 |
| 3744 | TKLKM | 1 |
| 3745 | TKLKR | 1 |
| 3746 | TKLNM | 1 |
| 3747 | TKLRK | 1 |
| 3748 | TKLRP | 1 |
| 3749 | TKLS . . . | 1 |
| 3750 | TKLTI | 1 |
| 3751 | TMLGG | 1 |
| 3752 | TMLKL | 1 |

TABLE 19-continued

ZF4
selection on G:T
change at nt 10 of core motif in CBS.
Sequences reflect position 2 to 6.

| SEQ ID NO: | Sequence | Read # |
|---|---|---|
| 3753 | TMLPG | 1 |
| 3754 | TPLKR | 1 |
| 3755 | TPLRA | 1 |
| 3756 | TQLKK | 1 |
| 3757 | TQLKL | 1 |
| 1941 | TQLKV | 1 |
| 3758 | TR*RL | 1 |
| 3759 | TRLKL | 1 |
| 110 | TRLRE | 1 |
|  | TS . . . | 1 |
| 3760 | TTLGI | 1 |
| 3761 | TYLKK | 1 |
| 3762 | VELDP | 1 |
| 3763 | VELVN | 1 |
| 3764 | VKLQQ | 1 |
| 3765 | VKLRL | 1 |
| 3766 | VKLRN | 1 |
| 3767 | VKLRV | 1 |
| 3768 | VLLKS | 1 |
| 3769 | VLLQM | 1 |
| 3770 | VMLKD | 1 |
| 3771 | VMLMG | 1 |
| 3772 | VPLAL | 1 |
| 3773 | VPLER | 1 |
| 3774 | VPLNT | 1 |
| 3775 | VPLSS | 1 |
| 3776 | VPLVP | 1 |
|  | VQ*G . . . | 1 |
| 3777 | VRLEE | 1 |
| 3778 | VRLQA | 1 |
| 3779 | VVTA . . . | 1 |
| 3780 | WHLKK | 1 |
|  | YG . . . | 1 |

TABLE 20

ZF4 selection on G:C change at nt 10 of core motif in CBS. Sequences reflect position 2 to 6.

| SEQ ID NO: | Sequence | Read # |
|---|---|---|
| 61 | AKLRV | 5924 |
| 3325 | TKLRV | 4888 |
| 64 | TKLKV | 3542 |
| 2137 | SKLKV | 3056 |
| 3319 | AKLKV | 2451 |
| 65 | SKLRV | 1583 |
| 3375 | SKLRT | 474 |
| 3350 | GKLRV | 320 |
| 63 | AKLRI | 254 |
| 3345 | GKLKV | 237 |
| 3312 | AKLKI | 164 |
| 1986 | AGLKR | 132 |
| 3322 | TKLKI | 129 |
| 1957 | GGLKV | 78 |
| 3326 | SKLKI | 76 |
| 3334 | SKLRI | 76 |
| 3527 | ARLGT | 64 |
| 3781 | VALGS | 48 |
| 3454 | GVLQK | 46 |
|  | TRS . . . | 39 |
| 60 | AHLRK | 30 |
| 3782 | AKLVV | 26 |
| 3783 | TKLRA | 24 |
| 3784 | LGLRG | 18 |
| 3652 | MRLAR | 15 |
| 3785 | TKLKA | 14 |
| 3722 | SKLKG | 13 |
| 3361 | TKLRI | 13 |
| 3365 | AKLRT | 12 |
|  | NGR . . . | 12 |
| 3786 | PNLAV | 12 |
| 3787 | GGLEV | 10 |
| 158 | GHLKK | 10 |
| 3788 | PREAI | 10 |
| 3789 | TKLKG | 10 |
| 3790 | TKLIV | 9 |
| 3791 | WILRA | 9 |

TABLE 20-continued

ZF4 selection on G:C change at nt 10 of core motif in CBS. Sequences reflect position 2 to 6.

| SEQ ID NO: | Sequence | Read # |
|---|---|---|
| 3792 | AK*RG | 8 |
| 3414 | AKLRA | 8 |
| 3311 | AKLRL | 8 |
| 3793 | EK*KV | 8 |
| 106 | GKLRI | 8 |
| 3310 | HHLTK | 8 |
| 3385 | THEKP . . . | 8 |
| 3794 | TK*RG | 8 |
| 3795 | TKLRT | 8 |
| 3315 | AKLKL | 7 |
| 3796 | AKLRE | 7 |
| 3437 | AKLTV | 7 |
| 3353 | EKLKV | 7 |
| 2187 | SKLKE | 7 |
| 3797 | TKLRG | 7 |
| 3509 | AKLRG | 6 |
| 1386 | EHLRR | 6 |
| 3798 | EKLRV | 6 |
| 3799 | RALW . . . | 6 |
| 2438 | SKLKA | 6 |
| 3504 | AKLKG | 5 |
| 3390 | AKLRM | 5 |
| 3400 | EVLTM | 5 |
| 3314 | QHLRK | 5 |
| 3800 | SKLVV | 5 |
| 1851 | STLKV | 5 |
| 3801 | TKLKE | 5 |
| 3802 | TKLNV | 5 |
| 3316 | GHLVK | 4 |
| 3320 | GKLRL | 4 |
| 3803 | KDALQYESECG . . . | 4 |
| 3804 | LSLVD | 4 |
| 3805 | QKLKV | 4 |
| 3806 | RELKE . . . | 4 |
| 3807 | RILGS | 4 |

TABLE 20-continued

ZF4
selection on G:C
change at nt 10 of core motif in CBS.
Sequences reflect position 2 to 6.

| SEQ ID NO: | Sequence | Read # |
|---|---|---|
| 163 | THLKK | 4 |
| 3309 | THLRA | 4 |
| 3808 | TKIRV | 4 |
| 160 | TKLRL | 4 |
| 3809 | TKLRM | 4 |
| 3810 | TKLVV | 4 |
| 3811 | TKVRV | 4 |
| 3812 | TRSHSR . . . | 4 |
| 159 | AHLKK | 3 |
| 3436 | AKLKA | 3 |
| 3813 | AKLRD | 3 |
| 1909 | ATLKV | 3 |
| 3532 | ATLRV | 3 |
| 3536 | DGLES | 3 |
| 3814 | GGLKG | 3 |
| 3418 | GHLRG | 3 |
| 162 | GHLRK | 3 |
| 3815 | GKLIV | 3 |
| 3816 | GKLKG | 3 |
| 3317 | GKLKI | 3 |
| 3451 | GKLVP | 3 |
| 3817 | KKLHW . . . | 3 |
| 3408 | QALSI | 3 |
| 3818 | RTLS . . . | 3 |
| 3819 | SKLRA | 3 |
| 3820 | SKVRV | 3 |
| 3427 | SLLAG | 3 |
| 3821 | TK*SV | 3 |
| 3822 | TKLAV | 3 |
| 3823 | TKLRE | 3 |
| 3824 | TKSRV | 3 |
| 3825 | TKVKV | 3 |
| 3826 | VMLMM | 3 |
| 3430 | VPLAG | 3 |
| 3431 | AGLLG | 2 |
| 3827 | AILQV | 2 |
| 3501 | AKIRV | 2 |
| 3435 | AKLIV | 2 |
| 3503 | AKLKE | 2 |
| 3828 | AKLMV | 2 |
| 3829 | AKLSV | 2 |
| 3830 | AKVKV | 2 |
| 3521 | ANLSN | 2 |
| 2315 | DKLRV | 2 |
| 3831 | ETLMH | 2 |
| 3416 | GALMG | 2 |
| 3444 | GGLQK | 2 |
| 3445 | GGLTM | 2 |
| 3333 | GHLKM | 2 |
| 3832 | GKSKV | 2 |
| 3592 | GLLGE | 2 |
| 3452 | GLLGL | 2 |
| 3453 | GNLGM | 2 |
| 2554 | GTLKR | 2 |
| 3456 | HLLEN | 2 |
| 3457 | IGLQR | 2 |
| 3833 | IKLRV | 2 |
| 3834 | KALHT | 2 |
| 3835 | KGLMM | 2 |
| 3836 | MELAE | 2 |
| 3423 | MGLVG | 2 |
| 3460 | MRLGE | 2 |
| 3656 | MTLPL | 2 |
| 2615 | NGLMR | 2 |
| 3402 | NGRS . . . | 2 |
| 3837 | NKLKV | 2 |
| 3838 | PRLLA | 2 |
| 3465 | PRLRH | 2 |
| 3839 | PRLSR | 2 |
| 3840 | QGLEA | 2 |
| 2434 | SELKV | 2 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3470 | SKLKR | 2 |
| 3841 | SKLRE | 2 |
| 3842 | SKLRG | 2 |
|  | TH*R... | 2 |
| 3843 | TKIKV | 2 |
| 161 | TKLKL | 2 |
| 3476 | TKLMV | 2 |
| 3389 | TKLQV | 2 |
| 3844 | TKLRD | 2 |
| 3845 | TKLSV | 2 |
| 3477 | TPLNI | 2 |
| 3478 | TRLQK | 2 |
| 3024 | TSLTR | 2 |
| 1919 | TTLRV | 2 |
|  | V | 2 |
| 3481 | AALES | 1 |
| 3846 | AELKA | 1 |
| 3847 | AELKV | 1 |
| 3484 | AELLG | 1 |
| 3486 | AGLAA | 1 |
| 3848 | AGLKH | 1 |
| 2475 | AGLRR | 1 |
| 2498 | AGLSR | 1 |
| 2473 | AGLTR | 1 |
| 1988 | AGLVR | 1 |
| 3490 | AHLKA | 1 |
| 287 | AHLKV | 1 |
| 90 | AHLRV | 1 |
| 3495 | AHLSP | 1 |
| 3849 | AKIRE | 1 |
| 3850 | AKLAV | 1 |
| 3851 | AKLGV | 1 |
| 3852 | AKLMI | 1 |
| 3853 | AKLNV | 1 |
| 3854 | AKLRF | 1 |
| 3855 | AKLRN | 1 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3387 | AKLTI | 1 |
| 3856 | AKLWV | 1 |
| 3857 | AKRRV | 1 |
| 3858 | AKSKV | 1 |
| 3859 | AKVRG | 1 |
| 3860 | ALLKV | 1 |
| 3517 | AMLIM | 1 |
| 3861 | AMLKV | 1 |
| 3440 | AMLMQ | 1 |
| 3519 | AMLRG | 1 |
| 3862 | AQLKV | 1 |
| 3863 | AQLRV | 1 |
| 3525 | AQLVD | 1 |
| 1945 | ARLKV | 1 |
| 3864 | ARLRI | 1 |
| 1993 | ARLRM | 1 |
| 1947 | ARLRV | 1 |
| 3865 | ATLQV | 1 |
| 3866 | AVLKV | 1 |
| 3867 | AYPRE | 1 |
| 3868 | CGLHW... | 1 |
| 3869 | CKLRV | 1 |
| 1995 | DALDR | 1 |
| 3535 | DELRV | 1 |
| 1852 | DGLKV | 1 |
| 2005 | DGLLR | 1 |
| 3537 | DGLMD | 1 |
| 3870 | DGLTG | 1 |
| 3538 | DGLVG | 1 |
| 3871 | DHLKR | 1 |
| 206 | DHLNV | 1 |
| 3543 | DLLGV | 1 |
| 3544 | DLLLN | 1 |
| 3545 | DNLRE | 1 |
| 3546 | DPLAR | 1 |
| 3872 | DRLTI | 1 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3873 | DVLKG | 1 |
| 3874 | DVLRG | 1 |
| 3875 | EALVH | 1 |
| 3551 | EELMM | 1 |
| 3267 | EGLRG | 1 |
| 3552 | EGLVE | 1 |
| 201 | EHLRV | 1 |
| 3349 | EHLVR | 1 |
| 3562 | EQLGP | 1 |
| 3876 | EQLMT | 1 |
| 3564 | ERLGR | 1 |
| 3565 | ESLMA | 1 |
| 3566 | ETLSH | 1 |
| 3877 | EVLAA | 1 |
| 3567 | EVLGI | 1 |
|  | G . . . | 1 |
| 3571 | GDLSG | 1 |
| 3573 | GGLDQ | 1 |
| 3878 | GGLKD | 1 |
| 3879 | GGLKI | 1 |
| 2659 | GGLNR | 1 |
| 3575 | GGLPE | 1 |
|  | GH*R . . . | 1 |
| 3393 | GHLKR | 1 |
| 3446 | GHLLR | 1 |
| 3580 | GHLMV | 1 |
| 3330 | GHLRR | 1 |
| 3363 | GHLRV | 1 |
| 3419 | GHLTL | 1 |
| 3448 | GHLVG | 1 |
| 3582 | GILAG | 1 |
| 3880 | GILRM | 1 |
| 3881 | GK*RG | 1 |
| 3584 | GKLKA | 1 |
| 3382 | GKLKM | 1 |
| 3882 | GKLML | 1 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3883 | GKLQV | 1 |
| 3588 | GKLRA | 1 |
| 3884 | GKLRQ | 1 |
| 3885 | GKLRT | 1 |
| 3394 | GKLTL | 1 |
| 3593 | GLLLD | 1 |
| 3594 | GLLMG | 1 |
| 3364 | GLLPG | 1 |
| 3595 | GLLRG | 1 |
| 3886 | GPLGQ | 1 |
| 3597 | GPLGV | 1 |
| 3887 | GPLMG | 1 |
| 3888 | GQLKA | 1 |
| 3889 | GRLAV | 1 |
| 3890 | GRLNA | 1 |
| 3601 | GSLST | 1 |
| 3602 | GSLVK | 1 |
| 3603 | GVLAG | 1 |
| 3604 | GVLLV | 1 |
| 3607 | HALRT | 1 |
| 3455 | HGLLP | 1 |
| 3612 | HIRS . . . | 1 |
| 3891 | HPLTV | 1 |
| 3892 | HRLTR | 1 |
| 3614 | IELVQ | 1 |
| 3615 | IGLGL | 1 |
| 3893 | IKLKV | 1 |
| 3894 | IMLKS | 1 |
| 3618 | IMLVE | 1 |
| 3895 | IQSGE | 1 |
| 3896 | IQVTLA | 1 |
| 3897 | IRLAL | 1 |
| 3621 | IRLG . . . | 1 |
| 3338 | IRLGV | 1 |
| 3342 | ITLM . . . | 1 |
| 3624 | IVLAA | 1 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3898 | KALRG | 1 |
| 3628 | KKLLE | 1 |
| 3899 | KKLRE | 1 |
| 3900 | KKLVR | 1 |
| 3629 | KMLPP | 1 |
| 3630 | KNLIK | 1 |
| 3631 | KSLMP | 1 |
| 3458 | KTLGV | 1 |
| 3632 | LALGG | 1 |
| 3633 | LGLGA | 1 |
| 3634 | LGLVG | 1 |
|  | LQ . . . | 1 |
| 3636 | LRLIG | 1 |
| 3901 | LSLDG | 1 |
| 3637 | LTLQR | 1 |
| 3638 | LVLRR | 1 |
|  | MA . . . | 1 |
| 3339 | MALGL | 1 |
| 3641 | MALTR | 1 |
| 3902 | MELDR | 1 |
| 3642 | MGLDP | 1 |
| 3643 | MGLGE | 1 |
| 3644 | MGLQN | 1 |
| 3646 | MKLEQ | 1 |
| 3903 | MKLQA | 1 |
| 3904 | MKLRV | 1 |
| 3647 | MLLRN | 1 |
| 3649 | MLLVN | 1 |
| 3905 | MPLLA | 1 |
| 3650 | MPLRA | 1 |
| 3906 | MRLARHIRSHTGERP . . . | 1 |
| 3653 | MRLMG | 1 |
| 3655 | MSLER | 1 |
| 3907 | MSLVN | 1 |
| 3657 | MTLSD | 1 |
| 3658 | MVLAG | 1 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3908 | MVLQE | 1 |
| 3909 | MVLVG | 1 |
|  | N . . . | 1 |
| 3910 | NDALEYESECGP . . . | 1 |
| 3911 | NDALQYESVCVP . . . | 1 |
| 2504 | NGLQR | 1 |
| 3912 | NGLVV | 1 |
| 3913 | NK*NV | 1 |
| 3914 | NKLRV | 1 |
| 3660 | NLAH | 1 |
| 3661 | NLLPT | 1 |
| 3663 | NRLGG | 1 |
| 3664 | NTLPK | 1 |
|  | NV . . . | 1 |
| 3915 | NVLGG | 1 |
| 3462 | NVLNK | 1 |
| 3916 | PGLAA | 1 |
| 3665 | PGLHG | 1 |
| 3669 | PKLGL | 1 |
| 3917 | PKLRA | 1 |
| 3670 | PLLKS | 1 |
| 3464 | PLLMP | 1 |
| 3918 | PNLAG | 1 |
| 3919 | PNYW . . . | 1 |
| 3671 | PQLTG | 1 |
| 3672 | PREAM | 1 |
| 3673 | PTLQR | 1 |
| 3920 | PVLDH | 1 |
|  | Q | 1 |
| 3921 | QALTN | 1 |
| 3674 | QELGR | 1 |
| 3675 | QGLPV | 1 |
| 3682 | QILLH | 1 |
| 3467 | QKLNL | 1 |
| 3684 | QNLHK | 1 |
| 3685 | QPLIK | 1 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3687 | QTLAE | 1 |
| 3922 | QVLRK | 1 |
| 3689 | RALSA | 1 |
| 3923 | RELVR | 1 |
|  | RGL . . . | 1 |
| 3924 | RGLDM | 1 |
| 3925 | RGLDR | 1 |
| 3691 | RGLTA | 1 |
| 3926 | RGLVA | 1 |
| 2953 | RGLVR | 1 |
| 3692 | RGLVV | 1 |
| 3694 | RHLRE | 1 |
| 3697 | RILPR | 1 |
| 3698 | RKLIV | 1 |
| 3927 | RKLKA | 1 |
| 3928 | RKLKV | 1 |
| 3929 | RKLRE | 1 |
| 3930 | RKLRV | 1 |
| 3931 | RKVRV | 1 |
| 3700 | RLLGA | 1 |
| 3701 | RLLMP | 1 |
| 3932 | RMLQE | 1 |
| 3703 | RMLVP | 1 |
| 3933 | RPLEV | 1 |
| 3705 | RRLVN | 1 |
| 3706 | RTLML | 1 |
| 3707 | RTLTQ | 1 |
|  | S*G . . . | 1 |
| 3708 | SDLHV | 1 |
| 2581 | SGLGR | 1 |
| 3710 | SGLLV | 1 |
| 2486 | SGLVR | 1 |
| 1848 | SHLKV | 1 |
| 3331 | SHLRL | 1 |
| 3934 | SKFKV | 1 |
| 3935 | SKFRV | 1 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3936 | SKIRT | 1 |
| 3469 | SKLHL | 1 |
| 3937 | SKLKD | 1 |
| 3358 | SKLKL | 1 |
| 3938 | SKLKM | 1 |
| 3939 | SKLQI | 1 |
| 92 | SKLRL | 1 |
| 3940 | SKLSV | 1 |
| 3941 | SKLTV | 1 |
| 3337 | SKLVL | 1 |
| 3942 | SKSRT | 1 |
| 3943 | SKVKV | 1 |
| 3944 | SKVRT | 1 |
| 3725 | SLLEE | 1 |
| 3726 | SLLGT | 1 |
| 3945 | SNLKG | 1 |
| 3946 | SNLTH | 1 |
| 3728 | SQLLE | 1 |
| 1857 | SRLKV | 1 |
| 3730 | STLLM | 1 |
| 3947 | TALIS | 1 |
| 3732 | TALRG | 1 |
| 3948 | TELIG | 1 |
| 3949 | TELKV | 1 |
|  | TG*S . . . | 1 |
| 2469 | TGLAR | 1 |
| 3733 | TGLGL | 1 |
| 2157 | TGLRV | 1 |
| 3385 | THEKP | 1 |
| 3737 | THIR . . . | 1 |
| 3738 | THLAR | 1 |
| 3429 | THLQK | 1 |
| 3318 | THLRK | 1 |
| 3344 | THLRL | 1 |
| 3329 | THLRT | 1 |
| 3950 | TKLHV | 1 |

TABLE 20-continued

ZF4
selection on G:C
change at nt 10 of core motif in CBS.
Sequences reflect position 2 to 6.

| SEQ ID NO: | Sequence | Read # |
|---|---|---|
| 3951 | TKLKD | 1 |
| 3744 | TKLKM | 1 |
| 3745 | TKLKR | 1 |
| 3952 | TKLKT | 1 |
| 3953 | TKLMA | 1 |
| 3746 | TKLNM | 1 |
| 3954 | TKLQI | 1 |
| 3955 | TKLR . . . | 1 |
| 3956 | TKLTV | 1 |
| 3957 | TKLWV | 1 |
| 3958 | TKSRD | 1 |
| 3751 | TMLGG | 1 |
| 3959 | TMLKV | 1 |
| 3753 | TMLPG | 1 |
| 3960 | TMLRV | 1 |
| 3754 | TPLKR | 1 |
| 1864 | TRLKV | 1 |
| 110 | TRLRE | 1 |
| 2168 | TRLRG | 1 |
| 1883 | TRLRV | 1 |
| 3961 | TRSHS . . . | 1 |
| 3962 | TTIRV | 1 |
| 3760 | TTLGI | 1 |
| 1849 | TTLKV | 1 |
| 3963 | TTLSA | 1 |
| 3964 | TTLVP | 1 |
| 3965 | TVLAP | 1 |
| 3966 | TVLPM | 1 |
| 3967 | VALTK | 1 |
| 3763 | VELVN | 1 |
| 3479 | VGLGQ | 1 |
| 3968 | VGLLR | 1 |
| 3969 | VKLLV | 1 |
| 3764 | VKLQQ | 1 |
| 3766 | VKLRN | 1 |
| 3767 | VKLRV | 1 |
| 3768 | VLLKS | 1 |
| 3970 | VLLMA | 1 |
| 3971 | VLLPS | 1 |
| 3770 | VMLKD | 1 |
| 3771 | VMLMG | 1 |
| 3972 | VNLLE | 1 |
| 3772 | VPLAL | 1 |
| 3773 | VPLER | 1 |
| 3774 | VPLNT | 1 |
| 3775 | VPLSS | 1 |
| 3776 | VPLVP | 1 |
|  | VQ*G . . . | 1 |
| 3973 | VQLPV | 1 |
| 3777 | VRLEE | 1 |
| 3778 | VRLQA | 1 |
| 2994 | VTLGR | 1 |
| 3974 | YTHMK | 1 |

TABLE 21

ZF4
selection on G:A
change at nt 10 of core motif in CBS.
Sequences reflect position 2 to 6.

| SEQ ID NO: | Sequence | Read # |
|---|---|---|
| 61 | AKLRV | 408 |
| 3350 | GKLRV | 294 |
|  | TRS | 180 |
| 64 | TKLKV | 170 |
| 3320 | GKLRL | 166 |
| 3402 | NGRS | 155 |
| 3325 | TKLRV | 124 |
| 3390 | AKLRM | 109 |
| 160 | TKLRL | 109 |
| 3345 | GKLKV | 107 |
| 3312 | AKLKI | 92 |
| 3319 | AKLKV | 88 |

TABLE 21-continued

ZF4
selection on G:A
change at nt 10 of core motif in CBS.
Sequences reflect position 2 to 6.

| SEQ ID NO: | Sequence | Read # |
|---|---|---|
| 186 | EKLRI | 84 |
| 3655 | MSLER | 68 |
| 3975 | NGRSPVC | 67 |
| 3416 | GALMG | 66 |
| 3976 | AELIR | 63 |
| 2581 | SGLGR | 63 |
| 3915 | NVLGG | 61 |
| 3977 | RGLT | 61 |
| 3978 | TLLMG | 58 |
| 3451 | GKLVP | 57 |
| 3430 | VPLAG | 57 |
| 3682 | QILLH | 55 |
| 3979 | TLPL | 55 |
| 3980 | *MLTS | 54 |
| 3981 | EMLTS | 53 |
| 2137 | SKLKV | 53 |
| 3615 | IGLGL | 52 |
| 3322 | TKLKI | 52 |
| 3495 | AHLSP | 51 |
| 3828 | AKLMV | 51 |
| 3982 | DALRG | 51 |
| 3633 | LGLGA | 51 |
| 3805 | QKLKV | 51 |
| 3408 | QALSI | 50 |
| 3983 | PLLET | 49 |
| 3984 | PSLM | 49 |
| 3452 | GLLGL | 48 |
| 3985 | TLLVG | 48 |
| 3766 | VKLRN | 48 |
| 62 | GGLGL | 47 |
| 3419 | GHLTL | 47 |
| 3986 | GPLHI | 46 |
| 3649 | MLLVN | 46 |
| 3987 | VELNS | 46 |
| 3988 | AKLIT | 45 |
| 3394 | GKLTL | 45 |
| 3946 | SNLTH | 45 |
| 3989 | AT*RR | 44 |
| 3544 | DLLLN | 44 |
| 3596 | GMLGG | 44 |
| 3923 | RELVR | 44 |
| 3990 | SPLLS | 44 |
| 3991 | DKLRR | 43 |
| 3570 | GALIM | 43 |
| 3992 | GLLG | 43 |
| 3993 | GLMM | 42 |
| 3994 | IHLAD | 42 |
| 3995 | TLTQ | 42 |
| 3996 | TRSHSS | 42 |
| 3997 | ALMQ | 41 |
| 1947 | ARLRV | 41 |
| 3321 | GHLRL | 41 |
| 3456 | HLLEN | 41 |
| 3998 | HTLNM | 41 |
| 3999 | PMLVD | 41 |
| 3469 | SKLHL | 41 |
| 4000 | GK*KL | 40 |
| 3440 | AMLMQ | 39 |
| 3546 | DPLAR | 39 |
| 3328 | GKLKL | 39 |
| 3914 | NKLRV | 39 |
| 3732 | TALRG | 39 |
| 3827 | AILQV | 38 |
| 3435 | AKLIV | 38 |
| 3311 | AKLRL | 38 |
| 3612 | HIRS | 38 |
| 3382 | GKLKM | 37 |
| 3592 | GLLGE | 37 |
| 3453 | GNLGM | 37 |
| 3582 | GILAG | 36 |
| 4001 | GPLAL | 36 |

TABLE 21-continued

ZF4
selection on G:A
change at nt 10 of core motif in CBS.
Sequences reflect position 2 to 6.

| SEQ ID NO: | Sequence | Read # |
|---|---|---|
| 3908 | MVLQE | 36 |
| 3669 | PKLGL | 36 |
| 4002 | ARLGL | 35 |
| 4003 | EELLK | 35 |
| 3647 | MLLRN | 35 |
| 3685 | QPLIK | 35 |
| 288 | AHLAV | 34 |
| 3400 | EVLTM | 34 |
| 3460 | MRLGE | 34 |
| 3548 | EALMA | 33 |
| 4004 | PLLGV | 33 |
| 3671 | PQLTG | 33 |
| 3877 | EVLAA | 32 |
| 4005 | HPLQQ | 32 |
| 3916 | PGLAA | 32 |
| 3467 | QKLNL | 32 |
| 4006 | SKLNN | 32 |
| 4007 | TRLRN | 32 |
| 3438 | AKLVL | 31 |
| 4008 | DLLV | 31 |
| 462 | DSLLA | 31 |
| 4009 | GELRT | 31 |
| 4010 | RLLGV | 31 |
| 2700 | AALTR | 30 |
| 3444 | GGLQK | 30 |
| 2615 | NGLMR | 30 |
| 4011 | NRLQ | 30 |
| 4012 | PALGN | 30 |
| 4013 | PLLGM | 30 |
| 4014 | PPLMQ | 30 |
| 4015 | TQLEE | 30 |
| 4016 | VGLEG | 30 |
| 3543 | DLLGV | 29 |
| 3572 | GGLDL | 29 |
| 3418 | GHLRG | 29 |
| 4017 | KTLRE | 29 |
| 4018 | PRLR | 29 |
| 4019 | PSLGV | 29 |
| 4020 | RR*PS | 29 |
| 3735 | TGLVD | 29 |
| 3429 | THLQK DGLMDHIRSH | 29 |
| 4021 | TGERPF | 28 |
| 3459 | LSLLK | 28 |
| 4022 | MVLVP | 28 |
| 4023 | SELTG | 28 |
| 4024 | SGLKH | 28 |
| 3754 | TPLKR | 28 |
| 4025 | VGLG | 28 |
| 60 | AHLRK | 27 |
| 3506 | AKLMN | 27 |
| 63 | AKLRI | 27 |
| 4026 | DRLGP | 27 |
| 4027 | GLLGR | 27 |
| 3617 | IMLRE | 27 |
| 4028 | KQLQP | 27 |
|  | MA*S | 27 |
|  | NGR | 27 |
| 3694 | RHLRE | 27 |
| 4029 | RPLLR | 27 |
| 4030 | RSLRL | 27 |
| 65 | SKLRV | 27 |
| 3427 | SLLAG | 27 |
| 3760 | TTLGI | 27 |
| 3484 | AELLG | 26 |
| 2473 | AGLTR | 26 |
| 3538 | DGLVG | 26 |
| 4031 | GALG | 26 |
| 4032 | GDLSP | 26 |
| 3573 | GGLDQ | 26 |
| 3580 | GHLMV | 26 |
| 3317 | GKLKI | 26 |
| 4033 | GKLSL | 26 |

TABLE 21-continued

ZF4
selection on G:A
change at nt 10 of core motif in CBS.
Sequences reflect position 2 to 6.

| SEQ ID NO: | Sequence | Read # |
|---|---|---|
| 3603 | GVLAG | 26 |
| 4034 | LRLNL | 26 |
| 4035 | MTLGN | 26 |
| 4036 | PMLAA | 26 |
| 3375 | SKLRT | 26 |
| 3746 | TKLNM | 26 |
| 4037 | ALIG | 25 |
| 4038 | AQLAN | 25 |
| 4039 | DGLAM | 25 |
| 3575 | GGLPE | 25 |
| 4040 | GLPV | 25 |
| 3631 | KSLMP | 25 |
| 2601 | NGLNR | 25 |
| 4041 | SHMK | 25 |
| 3477 | TPLNI | 25 |
| 3965 | TVLAP | 25 |
| 4042 | VLLME | 25 |
| 3431 | AGLLG | 24 |
| 4043 | GALPR | 24 |
| 4044 | GKLIL | 24 |
| 3882 | GKLML | 24 |
| 3604 | GVLLV | 24 |
| 4045 | KQLTD | 24 |
| 4046 | LKLIG | 24 |
| 3636 | LRLIG | 24 |
| 4047 | LRLMS | 24 |
| 3663 | NRLGG | 24 |
| 4048 | PNYWP | 24 |
| 4049 | RHLVP | 24 |
| 4050 | SRLGA | 24 |
| 3855 | AKLRN | 23 |
| 4051 | DRLAS | 23 |
| 3547 | DSLGE | 23 |
| 3563 | ERLAA | 23 |
| 106 | GKLRI | 23 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4052 | GSLS | 23 |
| 664 | HRLGG | 23 |
| 4053 | MDLLL | 23 |
| 4054 | MTLGA | 23 |
| 4055 | PPLER | 23 |
| 4056 | PVLPG | 23 |
| 3674 | QELGR | 23 |
| 3818 | RTLS | 23 |
| 4057 | SLLQG | 23 |
| 2157 | TGLRV | 23 |
| 3476 | TKLMV | 23 |
| 3773 | VPLER | 23 |
| 4058 | APLGM | 22 |
| 1386 | EHLRR | 22 |
| 2607 | GALVR | 22 |
| 2659 | GGLNR | 22 |
| 3446 | GHLLR | 22 |
| 4059 | GILAK | 22 |
| 4060 | GMLPD | 22 |
| 3597 | GPLGV | 22 |
| 4061 | GSLPM | 22 |
| 3602 | GSLVK | 22 |
| 3166 | GVLAR | 22 |
| 3634 | LGLVG | 22 |
| 3637 | LTLQR | 22 |
| 4062 | NGRSPVET | 22 |
| 3666 | PGLRA | 22 |
| 4063 | PMLRV | 22 |
| 4064 | TLML | 22 |
| 90 | AHLRV | 21 |
| 3515 | ALLMA | 21 |
| 4065 | ASLGQ | 21 |
| 3870 | DGLTG | 21 |
| 3267 | EGLRG | 21 |
| 223 | EHLAV | 21 |
| 4066 | ELILE | 21 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4067 | GH*RS | 21 |
| 4068 | GHLAM | 21 |
| 3589 | GKLRM | 21 |
| 4069 | GLLP | 21 |
| 4070 | GTLAI | 21 |
| 4071 | IRLKK | 21 |
| 4072 | KELRR | 21 |
| 3627 | KILPE | 21 |
| 4073 | LHLPI | 21 |
| 3423 | MGLVG | 21 |
| 3905 | MPLLA | 21 |
| 4074 | NELRG | 21 |
| 3462 | NVLNK | 21 |
| 4075 | PHLNG | 21 |
| 3464 | PLLMP | 21 |
| 4076 | RLLGS | 21 |
| 4077 | RTLIS | 21 |
| 4078 | SC*AS | 21 |
| 3708 | SDLHV | 21 |
| 92 | SKLRL | 21 |
| 4079 | VKLMN | 21 |
| 4080 | VTLIG | 21 |
| 4081 | AGLQE | 20 |
| 4082 | ALHT | 20 |
| 4083 | DPLVD | 20 |
|  | E | 20 |
| 4084 | EALDA | 20 |
| 4085 | GALAT | 20 |
| 4052 | GSLS | 20 |
| 4086 | GTLLM | 20 |
| 4087 | IKLRP | 20 |
|  | LQ | 20 |
|  | NGP | 20 |
| 3684 | QNLHK | 20 |
| 4088 | RRLLD | 20 |
| 3726 | SLLGT | 20 |
| 3948 | TELIG | 20 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4089 | TGLMG | 20 |
| 4090 | TKLLL | 20 |
| 4091 | TTLGA | 20 |
| 4092 | VE*DP | 20 |
| 3968 | VGLLR | 20 |
| 4093 | AGLGI | 19 |
| 4094 | AGLLQ | 19 |
| 3526 | ARLAG | 19 |
| 4095 | AVLSH | 19 |
| 3535 | DELRV | 19 |
| 4096 | DRLAG | 19 |
| 4097 | ERLSN | 19 |
| 4098 | ETLM | 19 |
| 4099 | GELRG | 19 |
| 3590 | GKLVA | 19 |
| 4100 | GRLNR | 19 |
| 4101 | GRLRL | 19 |
| 4102 | IMLAG | 19 |
| 4103 | IVLDP | 19 |
| 4104 | KVLAP | 19 |
| 4105 | LMLGM | 19 |
| 3641 | MALTR | 19 |
| 4106 | MPLRE | 19 |
| 4107 | RLLGP | 19 |
| 3819 | SKLRA | 19 |
| 4108 | SMYRS | 19 |
| 4109 | THLAK | 19 |
| 3762 | VELDP | 19 |
| 4110 | VGLTR | 19 |
| 3775 | VPLSS | 19 |
| 4111 | VQLPT | 19 |
| 2538 | AALRR | 18 |
| 4112 | AGLD | 18 |
| 3517 | AMLIM | 18 |
| 3519 | AMLRG | 18 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4113 | DVLPG | 18 |
| 3562 | EQLGP | 18 |
| 3393 | GHLKR | 18 |
| 3880 | GILRM | 18 |
| 4114 | GLLV | 18 |
| 4115 | GLMN | 18 |
| 4116 | GMLVG | 18 |
| 4117 | GPLTI | 18 |
| 4118 | GRLE | 18 |
| 4119 | GSLQS | 18 |
| 4120 | GVLVS | 18 |
| 4121 | HKLLK | 18 |
| 3614 | IELVQ | 18 |
| 3619 | IPLGD | 18 |
| 3632 | LALGG | 18 |
| 3648 | MLLSH | 18 |
| 4122 | MRLKV | 18 |
| 4123 | MRLRS | 18 |
| 4124 | MSLSP | 18 |
| 4125 | PALGG | 18 |
| 3665 | PGLHG | 18 |
| 3673 | PTLQR | 18 |
| 4126 | QPLAG | 18 |
| 4127 | SK*VV | 18 |
| 3842 | SKLRG | 18 |
| 4128 | TLIN | 18 |
| 4129 | TLLTP | 18 |
| 4130 | DALME | 17 |
| 4131 | EALNK | 17 |
| 4132 | EGLPT | 17 |
| 4133 | ELLKS | 17 |
| 4134 | GELTD | 17 |
| 3884 | GKLRQ | 17 |
| 3161 | GMLRR | 17 |
| 4135 | GPLVS | 17 |
| 4136 | GQLMM | 17 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4137 | GQLVG | 17 |
| 4138 | KGLEG | 17 |
| 4139 | QGLDN | 17 |
| 4140 | RALVS | 17 |
| 4141 | RGLAT | 17 |
| 3426 | SKLMV | 17 |
| 3800 | SKLVV | 17 |
| 3729 | SRLMA | 17 |
| 4142 | TLHE | 17 |
| 2168 | TRLRG | 17 |
| 3864 | ARLRI | 16 |
| 201 | EHLRV | 16 |
| 4143 | GHLKS | 16 |
| 4144 | GLLKH | 16 |
| 3890 | GRLNA | 16 |
| 4145 | GVLSI | 16 |
| 4146 | GVLST | 16 |
| 3607 | HALRT | 16 |
| 3900 | KKLVR | 16 |
| 3638 | LVLRR | 16 |
| 4147 | MPLVP | 16 |
| 3661 | NLLPT | 16 |
| 4148 | PKLQP | 16 |
| 4149 | PVLMG | 16 |
| 4150 | QALIG | 16 |
| 4151 | RGLIT | 16 |
| 3691 | RGLTA | 16 |
| 3705 | RRLVN | 16 |
| 4152 | RVQD | 16 |
| 3725 | SLLEE | 16 |
| 4153 | TELPM TGL | 16 16 |
| 3751 | TMLGG | 16 |
| 3776 | VPLVP | 16 |
| 4154 | APLDL | 15 |
| 4155 | ARLGR | 15 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4156 | DALSA | 15 |
| 4157 | EGLAG | 15 |
| 50 | GGLVR | 15 |
| 4158 | GGLVS | 15 |
| 3363 | GHLRV | 15 |
| 3815 | GKLIV | 15 |
| 3595 | GLLRG | 15 |
| 4159 | GMLGT | 15 |
| 4160 | GPLLG | 15 |
| 4161 | HIRSH | 15 |
| 3457 | IGLQR | 15 |
| 4162 | IMLV | 15 |
| 3897 | IRLAL | 15 |
| 304 | KALGT | 15 |
| 3898 | KALRG | 15 |
| 4163 | LHLQG | 15 |
| 4164 | MELMT | 15 |
| 4165 | MPLGG | 15 |
| 4166 | PGLAD | 15 |
| 4167 | PTLEV | 15 |
| 4168 | RQLGM | 15 |
| 4169 | RVLRG | 15 |
| 2525 | SGLLR | 15 |
| 4170 | SVLRV | 15 |
| 3733 | TGLGL | 15 |
| 4171 | TVLAG | 15 |
| 4172 | VGLA | 15 |
| 4173 | VGLRG | 15 |
| 3770 | VMLKD | 15 |
| 3774 | VPLNT | 15 |
| 2994 | VTLGR | 15 |
|  | WR | 15 |
|  | A | 14 |
| 4174 | AALHH | 14 |
| 3490 | AHLKA | 14 |
| 4175 | ALLGV | 14 |
| 3525 | AQLVD | 14 |
| 4176 | ARLHA | 14 |
| 4177 | DGLG | 14 |
| 4178 | DHLVG | 14 |
| 4179 | DILRG | 14 |
| 4180 | DQLVE | 14 |
| 4181 | DQLVG | 14 |
| 4182 | EKLMM | 14 |
| 4183 | ELLTP | 14 |
| 3564 | ERLGR | 14 |
| 4184 | GALRS | 14 |
| 3445 | GGLTM | 14 |
| 3583 | GKLHE | 14 |
| 4185 | GKLNI | 14 |
| 3406 | GKLVL | 14 |
| 4186 | GRLLE | 14 |
| 3628 | KKLLE | 14 |
| 3458 | KTLGV | 14 |
| 4187 | MALPE | 14 |
| 3653 | MRLMG | 14 |
| 4188 | NDALQYES | 14 |
| 3662 | NRLES | 14 |
| 3461 | NSLTR | 14 |
| 4189 | PKLRS | 14 |
| 4190 | PRLPP | 14 |
| 4191 | PVLKL | 14 |
| 4192 | QKLAN | 14 |
| 4193 | QKLKL | 14 |
| 4194 | RALPK | 14 |
| 3697 | RILPR | 14 |
| 4195 | THLGR | 14 |
| 3753 | TMLPG | 14 |
| 4196 | VALGT | 14 |
| 4197 | VKLHE | 14 |
| 4198 | VTLG | 14 |
| 4199 | ARLLG | 13 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4200 | ARLTG | 13 |
| 4201 | ASLGA | 13 |
| 4202 | DLLSG | 13 |
| 3545 | DNLRE | 13 |
| 4203 | EALTI | 13 |
| 3551 | EELMM | 13 |
| 4204 | ETLS | 13 |
| 4205 | GALGS | 13 |
| 3381 | GHLRT | 13 |
| 4206 | GPLVL | 13 |
| 4207 | GRLGA | 13 |
| 4208 | GRSYMA | 13 |
| 4209 | GVLGS | 13 |
| 4210 | HPLLV | 13 |
| 4211 | ITLSP | 13 |
| 3642 | MGLDP | 13 |
| 4212 | MLLNG | 13 |
| 4213 | MRLAE | 13 |
| 4214 | NMLSR | 13 |
| 4215 | PGLGG | 13 |
| 4216 | PGLVP | 13 |
| 3670 | PLLKS | 13 |
| 3468 | SHLRV | 13 |
| 4217 | SRLGV | 13 |
| 2469 | TGLAR | 13 |
| 4218 | TLMG | 13 |
| 4219 | TRLMM TRLREHIRSHT | 13 |
| 4220 | GERPF | 13 |
| 4221 | VELGP | 13 |
| 4222 | VHLAR | 13 |
| 4223 | VKLVG | 13 |
| 3486 | AGLAA | 12 |
| 4224 | APLRV | 12 |
| 4225 | EALV | 12 |
| 4226 | EVLPE | 12 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4227 | GALMN | 12 |
| 4228 | GLQA | 12 |
| 4229 | GLTG | 12 |
| 4230 | GTLGD | 12 |
| 4231 | HLLGP | 12 |
| 4232 | LKLKL | 12 |
| 4233 | MALRK | 12 |
| 4234 | MVLTG | 12 |
| 4235 | NGLIE | 12 |
| 4236 | NKLVV | 12 |
| 4237 | PALNV | 12 |
| 4238 | PMLRL | 12 |
| 4239 | PQLLG | 12 |
| 4240 | PVLRV | 12 |
| 4241 | QPLKR | 12 |
| 3924 | RGLDM | 12 |
| 4242 | RGLEN | 12 |
| 3700 | RLLGA | 12 |
| 4243 | RRLMV | 12 |
| 2486 | SGLVR | 12 |
| 4244 | SPLSG | 12 |
| 3728 | SQLLE | 12 |
| 4245 | SRLGR | 12 |
| 4246 | TGLVG | 12 |
| 3403 | THLRR | 12 |
| 3809 | TKLRM | 12 |
| 4247 | TKLVM | 12 |
| 4248 | TLLG | 12 |
| 4249 | TMLPR | 12 |
| 4250 | TNLRL | 12 |
| 4251 | TPLGE | 12 |
| 4252 | TPLVG | 12 |
| 4253 | TRLLT | 12 |
| 4254 | VGLGR | 12 |
| 4255 | VKLQ | 12 |

TABLE 21-continued

ZF4
selection on G:A
change at nt 10 of core motif in CBS.
Sequences reflect position 2 to 6.

| SEQ ID NO: | Sequence | Read # |
|---|---|---|
| 3768 | VLLKS | 12 |
| 4256 | AGLML | 11 |
| 3398 | AKLTL | 11 |
| 3521 | ANLSN | 11 |
| 4257 | ARLLT | 11 |
| 2880 | ATLLR | 11 |
| 4258 | EGLGG | 11 |
| 4259 | EGLHL | 11 |
| 3333 | GHLKM | 11 |
| 3889 | GRLAV | 11 |
| 4260 | GVLG | 11 |
| 4261 | LGLEG | 11 |
| 4262 | LNLQP | 11 |
| 4263 | LRLRT | 11 |
| 4264 | MELGD | 11 |
| 4265 | MLLQR | 11 |
| 4266 | MLPP | 11 |
| 4267 | MSLGG | 11 |
| 4268 | PKLII | 11 |
| 4269 | PNLQT | 11 |
| 4270 | PPLLS | 11 |
| 4271 | PTLGM | 11 |
| 4272 | QKLMT | 11 |
| 3687 | QTLAE | 11 |
| 3701 | RLLMP | 11 |
| 4273 | RRLVG | 11 |
| 4274 | SNLIM | 11 |
| 3730 | STLLM | 11 |
| 3738 | THLAR | 11 |
| 4275 | TLTM | 11 |
| 4276 | TRLGG | 11 |
| 3478 | TRLQK | 11 |
| 4277 | VGLLA | 11 |
| 4278 | VKLRM | 11 |
| 4279 | VLLGG | 11 |
| 4280 | VQ*GG | 11 |
| 3777 | VRLEE | 11 |
| 4281 | AGLSG | 10 |
| 4282 | AGLTE | 10 |
| 4283 | AGLVA | 10 |
| 4284 | ALSA | 10 |
| 4285 | ATLMK | 10 |
| 2468 | DGLAR | 10 |
| 206 | DHLNV | 10 |
| 4286 | EALAI | 10 |
| 4287 | EELVE | 10 |
| 4288 | EMLIP | 10 |
| 4289 | EPLAA | 10 |
| 4290 | ERLQE | 10 |
| 3878 | GGLKD | 10 |
| 3588 | GKLRA | 10 |
| 3591 | GKLVV | 10 |
| 4291 | GMLRV | 10 |
| 4292 | GPLME | 10 |
| 4293 | GVLSP | 10 |
| 4294 | IKLMG | 10 |
| 4295 | IPLNR | 10 |
| 4296 | MLLKG | 10 |
| 4297 | MRLPR | 10 |
| 4298 | MSLRE | 10 |
| 3918 | PNLAG | 10 |
| 4299 | PPLMV | 10 |
| 4300 | PTLGV | 10 |
| 4301 | RGLRN | 10 |
| 3692 | RGLVV | 10 |
| 4302 | RSLIV | 10 |
| 4303 | RTLGE | 10 |
| 4304 | SSLGV | 10 |
| 3947 | TALIS | 10 |
| 4305 | TGLGT | 10 |
| 3344 | THLRL | 10 |

TABLE 21-continued

ZF4
selection on G:A
change at nt 10 of core motif in CBS.
Sequences reflect position 2 to 6.

| SEQ ID NO: | Sequence | Read # |
|---|---|---|
| 3822 | TKLAV | 10 |
| 4306 | TKLLG | 10 |
| 4307 | TLIG | 10 |
| 4308 | TNLLR | 10 |
| 4309 | TTLGG | 10 |
| 4310 | VILGA | 10 |
| 3972 | VNLLE | 10 |
| 3481 | AALES | 9 |
| 4311 | AALGL | 9 |
| 4312 | AELMR | 9 |
| 4313 | AGLDG | 9 |
| 1988 | AGLVR | 9 |
| 3534 | DELMR | 9 |
| 4314 | DSLVI | 9 |
| 4315 | EKLKA | 9 |
| 3798 | EKLRV | 9 |
| 4316 | GKLIA | 9 |
| 4317 | GNLVT | 9 |
| 4318 | GRLLI | 9 |
| 4319 | GRLRS | 9 |
| 3239 | GSLIR | 9 |
| 2554 | GTLKR | 9 |
| 4320 | HELMK | 9 |
| 4321 | KMLGG | 9 |
| 4322 | LGLIQ | 9 |
| 4323 | LKLER | 9 |
| 4324 | LPLNG | 9 |
| 4325 | MGLGV | 9 |
| 3658 | MVLAG | 9 |
| 3909 | MVLVG | 9 |
| 2540 | NGLAR | 9 |
| 3668 | PILLQ | 9 |
| 4326 | PMLTV | 9 |
| 4327 | PPLII | 9 |
| 4328 | QRLVE | 9 |
| 3698 | RKLIV | 9 |
| 4329 | RKLKE | 9 |
| 4330 | RRLHE | 9 |
| 4331 | RVLGA | 9 |
| 2532 | SALAR | 9 |
| 4332 | SC*RP | 9 |
| 4333 | SGLDA | 9 |
| 4334 | SQLDR | 9 |
| 2507 | TGLLR | 9 |
| 3952 | TKLKT | 9 |
| 4335 | TSLTE | 9 |
| 2342 | AGLKM | 8 |
| 4336 | AGLRS | 8 |
| 4337 | AHLGQ | 8 |
| 3493 | AHLR | 8 |
| 4338 | ALME | 8 |
| 2875 | ASLRR | 8 |
| 1995 | DALDR | 8 |
| 4339 | DGLHG | 8 |
| 4340 | DGLLQ | 8 |
| 3550 | EELGL | 8 |
| 4341 | EKLRS | 8 |
| 3876 | EQLMT | 8 |
| 4342 | ERLAR | 8 |
| 3569 | GALGR | 8 |
| 4343 | GELKA | 8 |
| 2295 | GGLVV | 8 |
| 3341 | GHLRM | 8 |
| 4344 | GLML | 8 |
| 4345 | GLQN | 8 |
| 4346 | GLTA | 8 |
| 4347 | GMLGE | 8 |
| 4348 | GPLRR | 8 |
| 4349 | GVLDT | 8 |
| 4350 | GVLNT | 8 |
| 4351 | IQLAD | 8 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4352 | KGLTM | 8 |
| 4353 | MELGN | 8 |
| 4354 | MPLMR | 8 |
| 3657 | MTLSD | 8 |
| 4355 | NGLAM | 8 |
| 4356 | NGLQD | 8 |
| 4357 | NTLDV | 8 |
| 4358 | PHLSM | 8 |
| 4359 | PILLG | 8 |
| 4360 | PVLQG | 8 |
| 4361 | QGLGG | 8 |
| 4362 | QKLQI | 8 |
| 4363 | QPLIA | 8 |
| 3926 | RGLVA | 8 |
| 3727 | SLLNG | 8 |
| 4364 | SRLTD | 8 |
| 4365 | TLLGD | 8 |
| 4366 | TRSHSSV | 8 |
| 3024 | TSLTR | 8 |
| 4367 | TTLGD | 8 |
| 4368 | VKLAP | 8 |
| 3973 | VQLPV | 8 |
| 3367 | AALRK | 7 |
| 159 | AHLKK | 7 |
| 4369 | AKLHP | 7 |
| 4370 | AVLEN | 7 |
| 3571 | GDLSG | 7 |
| 4371 | GELGV | 7 |
| 187 | GKLVT | 7 |
| 3593 | GLLLD | 7 |
| 3594 | GLLMG | 7 |
| 4372 | GLMA | 7 |
| 4373 | GLNR | 7 |
| 4374 | GLVV | 7 |
| 4375 | GPLPV | 7 |
| 4376 | GSLTQ | 7 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4377 | GVLRG | 7 |
| 4378 | HPLAV | 7 |
| 4379 | HTLGM | 7 |
| 4380 | IQLGG | 7 |
| 4381 | KLLGD | 7 |
| 3630 | KNLIK | 7 |
| 4382 | MALAR | 7 |
| 4383 | MELEP | 7 |
| 4384 | MGLAN | 7 |
| 3643 | MGLGE | 7 |
| 4385 | MPLDG | 7 |
| 4386 | NVLGR | 7 |
| 4387 | PGLPE | 7 |
| 4388 | PHLQN | 7 |
| 4389 | PRLGS | 7 |
| 4390 | PSLLV | 7 |
| 4391 | PTLAR | 7 |
| 4392 | QMLER | 7 |
| 4393 | RDLGS | 7 |
| 4394 | RGLGN | 7 |
| 4395 | RLLEK | 7 |
| 3703 | RMLVP | 7 |
| 4396 | SVLSG | 7 |
| 4397 | TGLVN | 7 |
| 4398 | TLA*SH | 7 |
| 4399 | TRLHT | 7 |
| 3967 | VALTK | 7 |
| 3771 | VMLMG | 7 |
| 4400 | VVLAG | 7 |
| 4401 | AGLVG | 6 |
| 3315 | AKLKL | 6 |
| 4402 | AR*PS | 6 |
| 1945 | ARLKV | 6 |
| 2005 | DGLLR | 6 |
| 4403 | DKLHR | 6 |

TABLE 21-continued

ZF4
selection on G:A
change at nt 10 of core motif in CBS.
Sequences reflect position 2 to 6.

| SEQ ID NO: | Sequence | Read # |
|---|---|---|
| 2203 | DKLKV | 6 |
| 4404 | ERLPV | 6 |
| 4405 | GDLVE | 6 |
| 4406 | GELGE | 6 |
| 4407 | GGLMQ | 6 |
| 4408 | GLLT | 6 |
| 4409 | GLPG | 6 |
| 4410 | GSLRT | 6 |
| 4411 | GTLQV | 6 |
| 4412 | GVLKS | 6 |
| 4413 | HGLVN | 6 |
| 4414 | IELGR | 6 |
| 4415 | KPLEL | 6 |
| 4416 | MKLE | 6 |
| 3664 | NTLPK | 6 |
| 4417 | PALMR | 6 |
| 303 | PHLVV | 6 |
| 4418 | PPLVV | 6 |
| 4419 | QALVP | 6 |
| 4420 | QELGG | 6 |
| 3370 | QHLRR | 6 |
| 4421 | QTLGV | 6 |
| 4422 | RILEP | 6 |
| 4423 | RLLMN | 6 |
| 4424 | RPLVG | 6 |
| 4425 | RRLEP | 6 |
| 4426 | SGLRA | 6 |
| 4427 | SKLMA | 6 |
| 3940 | SKLSV | 6 |
| 4428 | TMLEP | 6 |
| 4429 | TRSQ | 6 |
| 4430 | VALRK | 6 |
| 4431 | VDLSG | 6 |
| 4432 | VMLLG | 6 |
| 4433 | VPLSE | 6 |
| 2718 | AGLDR | 5 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4434 | ARLPV | 5 |
| 4435 | ARYGC | 5 |
| 1909 | ATLKV | 5 |
| 2317 | DGLRA | 5 |
| 4436 | ERLLQ | 5 |
| 4437 | ETLMG | 5 |
| 4438 | GHLML | 5 |
| 4439 | GHLQG | 5 |
| 4440 | GKLMV | 5 |
| 4441 | GPLG | 5 |
| 4442 | GPLTM | 5 |
| 4443 | GQLV | 5 |
| 4444 | GSLTL | 5 |
| 4445 | GTLRA | 5 |
| 4446 | GTLTG | 5 |
| 3310 | HHLTK | 5 |
| 4447 | IVLVR | 5 |
| 4448 | MALVR | 5 |
| 4449 | MELGK | 5 |
| 4450 | MGLEG | 5 |
| 4451 | MGLMA | 5 |
| 4452 | MPLNR | 5 |
| 4453 | NMLGG | 5 |
| 4454 | NPLEL | 5 |
| 4455 | NSLGG | 5 |
| 4456 | PRLLQ | 5 |
| 4457 | PRLVK | 5 |
| 2953 | RGLVR | 5 |
| 4458 | RHLRS | 5 |
| 4459 | RSLVV RSPV*ERMWI | 5 |
| 4460 | LRA | 5 |
| 4461 | RTLNA | 5 |
| 4462 | TELN | 5 |
| 4463 | VKLRA | 5 |
| 4464 | VLLQD | 5 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4465 | VMLG | 5 |
| 4466 | AGLNG | 4 |
| 4467 | AHLRM | 4 |
| 3414 | AKLRA | 4 |
| 4468 | AR*RA | 4 |
| 4469 | ARLPE | 4 |
| 4470 | AVLNKDALQYESECG | 4 |
| 4471 | GLNH | 4 |
| 3030 | DTLLR | 4 |
| 4472 | EGLRD | 4 |
| 4473 | ESLMGG | 4 4 |
| 4474 | GELV | 4 |
| 4475 | GGLRP | 4 |
| 158 | GHLKK | 4 |
| 3584 | GKLKA | 4 |
| 4476 | GLIG | 4 |
| 4477 | GLIS | 4 |
| 4478 | GLLGN | 4 |
| 4479 | GMLVN | 4 |
| 4480 | GPLED | 4 |
| 4481 | GPLQA | 4 |
| 4482 | GTLTV | 4 |
| 4483 | GVLGI | 4 |
| 4484 | IDLGM | 4 |
| 4485 | IELGG | 4 |
| 4486 | IGLAT | 4 |
| 4487 | KKLMP | 4 |
| 4488 | KLLGE | 4 |
| 4489 | KLLLG | 4 |
| 3629 | KMLPP | 4 |
| 4490 | MGLTL | 4 |
| 4491 | MNLGM | 4 |
| 4492 | MPLMV | 4 |
| 3650 | MPLRA | 4 |

TABLE 21-continued

ZF4
selection on G:A
change at nt 10 of core motif in CBS.
Sequences reflect position 2 to 6.

| SEQ ID NO: | Sequence | Read # |
|---|---|---|
| 3651 | MQLGG | 4 |
| 2085 | MRLRM | 4 |
| 4493 | PALTV | 4 |
| 4494 | PGLAL | 4 |
| 4495 | PGLMG | 4 |
| 4496 | PHLMS | 4 |
| 4497 | PQLSA | 4 |
| 4498 | PRLKA | 4 |
| 4499 | QKLIR | 4 |
| 4500 | RELGV | 4 |
| 4501 | RGLHQ | 4 |
| 4502 | RGLIG | 4 |
| 4503 | RGLMG | 4 |
| 4504 | RTRSH | 4 |
| 4505 | SQLDT | 4 |
| 4506 | TELGG | 4 |
| 163 | THLKK | 4 |
| 3309 | THLRA | 4 |
| 4507 | TKLGV | 4 |
| 4508 | TMLEG | 4 |
| 4509 | VSLGV | 4 |
| 4510 | VSLTA | 4 |
| 4511 | VSLVG | 4 |
| 1986 | AGLKR | 3 |
| 4512 | AGLQN | 3 |
| 4513 | AGLRV | 3 |
| 3516 | ALLRR | 3 |
| 4514 | ARLRT | 3 |
| 4515 | ASLQK | 3 |
| 4516 | ASLR | 3 |
| 2772 | ATLSR | 3 |
| 4517 | DILGE | 3 |
| 4518 | EELRM | 3 |
| 4519 | EGLTG | 3 |
| 4520 | EMLKE | 3 |
| 4521 | ESLLG | 3 |

TABLE 21-continued

ZF4
selection on G:A
change at nt 10 of core motif in CBS.
Sequences reflect position 2 to 6.

| SEQ ID NO: | Sequence | Read # |
|---|---|---|
| 3565 | ESLMA | 3 |
| 4522 | ETLAG | 3 |
| 4523 | EVLVQ | 3 |
| 2521 | GALKR | 3 |
| 2745 | GGLGR | 3 |
| 162 | GHLRK | 3 |
| 4524 | GKLRS | 3 |
| 4525 | GLKT | 3 |
| 4526 | GLLGV | 3 |
| 4527 | GMLLP | 3 |
| 4528 | GMLSG | 3 |
| 3887 | GPLMG | 3 |
| 4529 | GRLAP | 3 |
| 4530 | GSLLR | 3 |
| 4531 | GTLTM | 3 |
|  | GVI | 3 |
| 4532 | ILLQQ | 3 |
| 4533 | KLLQM | 3 |
| 4534 | LGLPG | 3 |
| 4535 | MELVL | 3 |
| 4536 | MGLAG | 3 |
| 4537 | MGLPV | 3 |
| 3644 | MGLQN | 3 |
| 4538 | MQLAD | 3 |
| 4539 | MSLLR | 3 |
| 4540 | MSLPE | 3 |
| 4541 | NGLKQ | 3 |
| 2504 | NGLQR | 3 |
| 4542 | NGRSPV*E | 3 |
| 4543 | NPLSR | 3 |
| 4544 | NQLVA | 3 |
| 4545 | NTLGL | 3 |
| 4546 | PRLRV | 3 |
| 4547 | PVLLM | 3 |
| 4548 | PVLTG | 3 |
| 3314 | QHLRK | 3 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4549 | QQLL | 3 |
| 4550 | RGLVN | 3 |
| 4551 | RHLVV | 3 |
| 4552 | RLLAE | 3 |
| 4553 | RLLPG | 3 |
| 4554 | RPLIT | 3 |
| 4555 | RVLMN | 3 |
| 4556 | RVLQR | 3 |
| 2580 | SGLER | 3 |
| 161 | TKLKL | 3 |
| 4557 | TLLPG | 3 |
| 110 | TRLRE | 3 |
| 3249 | TSLER | 3 |
| 4558 | VGLPA | 3 |
| 4559 | VPLRP | 3 |
| 4560 | VRLMP | 3 |
| 4561 | VSLGE | 3 |
| 4562 | AALTK | 2 |
| 4563 | AALVK | 2 |
| 4564 | AHLTP | 2 |
| 4565 | AILRT | 2 |
| 4566 | AKLNS | 2 |
| 3853 | AKLNV | 2 |
| 3509 | AKLRG | 2 |
| 4567 | ALLGA | 2 |
| 4568 | ARLLR | 2 |
| 3528 | ARLRA | 2 |
| 4569 | DVLG | 2 |
| 4570 | EELQS | 2 |
| 3552 | EGLVE | 2 |
| 4571 | ELLGP | 2 |
| 4572 | ERMC | 2 |
| 4573 | EVLAG | 2 |
| 4574 | GALGE | 2 |
| 4575 | GDLVP | 2 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4576 | GELRI | 2 |
| 4577 | GGLEL | 2 |
| 4578 | GHLSP | 2 |
| 4579 | GKLEA | 2 |
| 4580 | GKLKR | 2 |
| 2912 | GKLRR | 2 |
| 4581 | GKLVI | 2 |
| 4582 | GLHQ | 2 |
| 4583 | GLLR | 2 |
| 4584 | GLMV | 2 |
| 4585 | GLTL | 2 |
| 117 | GNLVR | 2 |
| 4586 | GPLVG | 2 |
| 4587 | GQLVD | 2 |
| 4588 | GRLSV | 2 |
| 4589 | GVLAV | 2 |
| 3609 | HGLTG | 2 |
| 4590 | HVLEL | 2 |
| 4591 | IELEM | 2 |
| 4592 | IGLQA | 2 |
| 4593 | KGLGN | 2 |
| 4594 | KILPV | 2 |
| 4595 | KPLPG | 2 |
| 4596 | KSLRM | 2 |
| 4597 | KTLGT | 2 |
| 4598 | LGLAA | 2 |
| 4599 | LGLGG | 2 |
| 4600 | LVLQE | 2 |
| 4601 | MGLAS | 2 |
| 4602 | MLLEE | 2 |
| 771 | MLPA | 2 |
| 3652 | MRLAR | 2 |
| 4603 | MSLRQ | 2 |
| 4604 | MTLGT | 2 |
| 4605 | NGLIV | 2 |
| 4606 | NHLRM | 2 |

TABLE 21-continued

ZF4
selection on G:A
change at nt 10 of core motif in CBS.
Sequences reflect position 2 to 6.

| SEQ ID NO: | Sequence | Read # |
|---|---|---|
|  | NLA | 2 |
| 4607 | PALIM | 2 |
| 4608 | PGLAG | 2 |
| 4609 | PLLRA | 2 |
| 4610 | PPLDG | 2 |
| 4611 | PPLIM | 2 |
| 4612 | PPLLG | 2 |
| 4613 | PQLTE | 2 |
| 4614 | PVLDG | 2 |
| 4615 | QGLTT | 2 |
| 4616 | QRLAV | 2 |
| 4617 | RELGG | 2 |
| 4618 | RGLDG | 2 |
| 4619 | RGLTE | 2 |
| 4620 | RHLGA | 2 |
| 4621 | RSLMI | 2 |
| 4622 | RSLRP | 2 |
| 3721 | SKLGA | 2 |
| 4623 | SKLGE T*LT | 2 2 |
| 2443 | TALKV | 2 |
| 4624 | THLR | 2 |
| 1864 | TRLKV | 2 |
| 4625 | TRLPP | 2 |
| 4626 | VELGD | 2 |
| 3763 | VELVN | 2 |
| 2459 | VGLGG | 2 |
| 4627 | VGLKD | 2 |
| 4628 | VKLHV | 2 |
| 4629 | VKLLS | 2 |
| 4630 | VQLTK | 2 |
| 4631 | VRLK | 2 |
| 4632 | VRLPP | 2 |
| 4633 | AALEN | 1 |
| 4634 | AALGP | 1 |
| 4635 | AALGT | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4636 | AALKI | 1 |
| 4637 | AALMN | 1 |
| 4638 | AALMQ | 1 |
| 2865 | AALMR | 1 |
| 4639 | AALRV | 1 |
| 4640 | AALSS | 1 |
| 4641 | AELGP | 1 |
| 4642 | AELRA | 1 |
| 3485 | AELRI | 1 |
| 4643 | AGIAA | 1 |
| 4644 | AGILQ | 1 |
| 4645 | AGLDS | 1 |
| 4646 | AGLG | 1 |
| 4647 | AGLGG | 1 |
| 4648 | AGLGN | 1 |
| 4649 | AGLGP | 1 |
| 4650 | AGLGQ | 1 |
| 4651 | AHFRV | 1 |
| 4652 | AHLRG | 1 |
| 4653 | AHLRP | 1 |
| 4654 | AKFRM | 1 |
| 4655 | AKLE | 1 |
| 4656 | AKLGE | 1 |
| 4657 | AKLGL | 1 |
| 4658 | AKLHA | 1 |
| 3504 | AKLKG | 1 |
| 4659 | AKLLG | 1 |
| 4660 | AKLML | 1 |
| 4661 | AKLQP | 1 |
| 3854 | AKLRF | 1 |
| 4662 | AKLRQ | 1 |
| 4663 | AKLS | 1 |
| 4664 | AKLTN | 1 |
| 4665 | AKLWL | 1 |
| 4666 | ALDA | 1 |
| 4667 | ALIM | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4668 | ALKG | 1 |
| 4669 | ALLGE | 1 |
| 4670 | ALLRS | 1 |
| 4671 | ALTG | 1 |
| 4672 | ALTR | 1 |
| 4673 | AMLPD | 1 |
| 4674 | AMLR | 1 |
| 4675 | APLAG | 1 |
| 4676 | APLGP | 1 |
| 4677 | AQLAD | 1 |
| 4678 | AQLLL | 1 |
| 4679 | AR*RG | 1 |
| 4680 | ARLAA | 1 |
| 3527 | ARLGT | 1 |
| 4681 | ARLMS | 1 |
| 4682 | ARLRS | 1 |
| 4683 | ARLTE | 1 |
| 4684 | ARYGR | 1 |
| 4685 | ASLGP | 1 |
| 4686 | ASLRP | 1 |
| 4687 | AT*RS | 1 |
| 4688 | ATLAK | 1 |
| 4689 | ATLEV | 1 |
| 4690 | ATLKI | 1 |
| 4691 | ATLMG | 1 |
| 4692 | ATLNM | 1 |
| 4693 | ATLNV | 1 |
| 4694 | AVIG | 1 |
| 4695 | CGLGR | 1 |
| 4696 | DALQP | 1 |
| 1999 | DALTV | 1 |
| 4697 | DELM | 1 |
| 4698 | DELMN | 1 |
| 4699 | DELRA | 1 |
| 4700 | DGLE | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4701 | DGLEK | 1 |
| 3536 | DGLES | 1 |
| 4702 | DGLML DGLTGHIRSHT | 1 |
| 4703 | GERPF | 1 |
| 4704 | DGVAM | 1 |
| 4705 | DHLVD | 1 |
| 4706 | DILG | 1 |
| 4707 | DILRT | 1 |
| 2348 | DKLKG | 1 |
| 4708 | DKLMM | 1 |
| 4709 | DLLA | 1 |
| 4710 | DLLAR | 1 |
| 103 | DNLRV | 1 |
| 4711 | DRLAA | 1 |
| 4712 | DRLGG | 1 |
| 4713 | DSLPE | 1 |
| 4714 | DSLV | 1 |
| 3874 | DVLRG | 1 |
| 4715 | DYLNV | 1 |
| 4716 | EALA | 1 |
| 4717 | EALKV | 1 |
| 4718 | EALMV | 1 |
| 4719 | EALTN | 1 |
| 4720 | EELAP EELMMHIRSH | 1 |
| 4721 | TGERPF EELVEHIRSHT | 1 |
| 4722 | GERPF | 1 |
| 3377 | EHLRL | 1 |
| 3349 | EHLVR | 1 |
| 4723 | EKLIV | 1 |
| 3353 | EKLKV | 1 |
| 4724 | ELLAR | 1 |
| 4725 | ELLPS | 1 |
| 4726 | EMLVA | 1 |
| 4727 | EQLGT | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4728 | ERLAV | 1 |
| 93 | ERLRV | 1 |
| 4729 | ETLNS | 1 |
| 4730 | ETSSH | 1 |
| 4731 | EVLAV | 1 |
| 3567 | EVLGI | 1 |
| 4732 | EVLIQ | 1 |
| 4733 | EVLQE | 1 |
| 4734 | GALGL | 1 |
| 4735 | GALGV | 1 |
| 4736 | GALIS | 1 |
| 4737 | GALMQ | 1 |
| 4738 | GALRD | 1 |
| 4739 | GALRG | 1 |
| 4740 | GAVMN | 1 |
| 4741 | GE*GI | 1 |
| 4742 | GELKV | 1 |
| 4743 | GELML | 1 |
| 4744 | GELMR | 1 |
| 4745 | GELRV | 1 |
| 4746 | GELTG | 1 |
| 4747 | GFLAR | 1 |
| 4748 | GGFRD | 1 |
| 4749 | GGLA | 1 |
| 4750 | GGLAE | 1 |
| 368 | GGLGA | 1 |
| 4751 | GGLGE | 1 |
| 4752 | GGLGP | 1 |
| 4753 | GGLHP | 1 |
| 1957 | GGLKV | 1 |
| 4754 | GGLMD | 1 |
| 4755 | GGLMT | 1 |
| 4756 | GGLNI | 1 |
| 2357 | GGLRG | 1 |
| 4757 | GGLRL | 1 |
| 4758 | GGLSG | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4759 | GGLVG | 1 |
| 4760 | GGVGL | 1 |
| 4761 | GHLAI | 1 |
| 4762 | GHLQC | 1 |
| 3159 | GHLQR | 1 |
| 3330 | GHLRR | 1 |
| 4763 | GHLSV | 1 |
| 3448 | GHLVG | 1 |
| 3316 | GHLVK | 1 |
| 4764 | GILAR | 1 |
| 4765 | GILSG | 1 |
| 4766 | GKLAI | 1 |
| 4767 | GKLGG | 1 |
| 4768 | GKLIG | 1 |
| 4769 | GKLII | 1 |
| 4770 | GKLIT GKLKMHIRSH | 1 |
| 4771 | TGERPF | 1 |
| 4772 | GKLLK | 1 |
| 4773 | GKLNA | 1 |
| 4774 | GKLPT | 1 |
| 4775 | GKLQA | 1 |
| 3587 | GKLR | 1 |
| 3588 | GKLRA | 1 |
| 4776 | GKLRE | 1 |
| 4777 | GKLT | 1 |
| 4778 | GKLTM | 1 |
| 4779 | GLAA | 1 |
| 4780 | GLIV | 1 |
| 4781 | GLLEK | 1 |
| 4782 | GLLGG | 1 |
| 4783 | GLLMV | 1 |
| 3364 | GLLPG | 1 |
| 4784 | GLLQD | 1 |
| 4785 | GLLTG | 1 |
| 4786 | GLSG | 1 |
| 4787 | GLSGR | 1 |
| 4788 | GLSV | 1 |
| 4789 | GLVN | 1 |
| 4790 | GLVQ | 1 |
| 4791 | GMLAG | 1 |
| 4792 | GNLSN | 1 |
| 727 | GPLA | 1 |
| 4793 | GPLKP | 1 |
| 4794 | GPLRP | 1 |
| 4795 | GPLVP | 1 |
| 4796 | GQLGP | 1 |
| 4797 | GQLLE | 1 |
| 4798 | GR*ML | 1 |
| 4799 | GRLGG | 1 |
| 4800 | GRLLG | 1 |
| 4801 | GRLMP | 1 |
| 4802 | GRLVS | 1 |
| 4803 | GRYGC | 1 |
| 3279 | GSLRV | 1 |
| 4804 | GSLSK | 1 |
| 4805 | GSLSP | 1 |
| 4806 | GTLKL | 1 |
| 4807 | GTLLL | 1 |
| 2685 | GTLLV | 1 |
| 4808 | GTLMT | 1 |
| 2192 | GTLRV | 1 |
| 4809 | GTLTE | 1 |
| 4810 | GVIN | 1 |
|  | GVL | 1 |
| 4811 | GVLDN | 1 |
| 4812 | GVLE | 1 |
| 4813 | GVLKD | 1 |
| 3454 | GVLQK | 1 |
| 4814 | GVLRL | 1 |
| 4815 | GVLSG | 1 |
| 2220 | GVLTG | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4816 | GVMN | 1 |
| 4817 | GVPV | 1 |
| 4818 | HELMR | 1 |
| 4819 | HLLVP | 1 |
| 4820 | HPLDR | 1 |
| 4821 | HPLLS | 1 |
| 4822 | HPVKE | 1 |
| 4823 | HTLKM | 1 |
| 4824 | HTLLK | 1 |
| 4825 | HTLNI | 1 |
| 3178 | HTLNK | 1 |
| 4826 | HTLRP | 1 |
| 4827 | IALPG | 1 |
| 4828 | IELAL | 1 |
| 4829 | IELG | 1 |
| 4830 | IELHL | 1 |
| 4831 | IGIQR | 1 |
| 4832 | IGLGA | 1 |
| 4833 | IGLRL | 1 |
| 4834 | IHLAG | 1 |
| 4835 | IHLRM | 1 |
| 4836 | IKLTG | 1 |
| 4837 | IMLPR | 1 |
| 4838 | IQLMG | 1 |
| 4839 | IQLRL | 1 |
| 4840 | IRLAA | 1 |
| 4841 | IRLGP | 1 |
| 3338 | IRLGV | 1 |
| 4842 | IRLRR | 1 |
| 4843 | ISLVG | 1 |
| 4844 | ITLMV | 1 |
| 4845 | ITLRG | 1 |
| 4846 | ITLRP | 1 |
| 4847 | ITLVG | 1 |
| 4848 | IVLPGKG | 1 |
| 4849 | KGLAT | 1 |
| 4850 | KGLDL | 1 |
| 4851 | KGLMR | 1 |
| 4852 | KGRSPVET | 1 |
| 4853 | KIIV | 1 |
| 4854 | KILLA | 1 |
| 4855 | KKLAG | 1 |
| 4856 | KKLGV | 1 |
| 4857 | KKLRI | 1 |
| 4858 | KLLAG | 1 |
| 4859 | KLLRV | 1 |
| 4860 | KPLAA | 1 |
| 4861 | KPLMV | 1 |
| 4862 | KRLEG | 1 |
| 4863 | KSLVG | 1 |
| 4864 | KTLEG | 1 |
| 4865 | KTLRG | 1 |
| 2404 | KTLRV | 1 |
| 4866 | KTLVG | 1 |
| 4867 | KVLPV | 1 |
| 4868 | LAHGT | 1 |
| 4869 | LGLGP | 1 |
| 4870 | LGLGV | 1 |
| 4871 | LKVKL | 1 |
| 4872 | LNLHT | 1 |
| 4873 | LRLIM | 1 |
| 4874 | LRVIG | 1 |
| 4875 | LSLSG | 1 |
| 4876 | LTLQQ | 1 |
| 4877 | LVLRG | 1 |
| 4878 | MALRG | 1 |
| 4879 | MELIG | 1 |
| 4880 | MGLRV | 1 |
| 4881 | MLAA | 1 |
| 4882 | MLLIS | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4883 | MLLLP | 1 |
| 4884 | MLLMV | 1 |
| 4885 | MLLPP | 1 |
| 4886 | MLLPV | 1 |
| 4887 | MLLV | 1 |
| 4888 | MLLVG | 1 |
| 4889 | MLVG | 1 |
| 4890 | MMLDP | 1 |
| 4891 | MPLGA | 1 |
| 4892 | MPLGL | 1 |
| 4893 | MPLLG | 1 |
| 4894 | MRLEE | 1 |
| 4895 | MRLGA | 1 |
| 4896 | MRLGG | 1 |
| 4897 | MRLGR | 1 |
| 3654 | MRLVG | 1 |
| 4898 | MSLHG | 1 |
| 4899 | MSLQQ | 1 |
| 4900 | MTLER | 1 |
|  | MVL | 1 |
| 4901 | MVLMN | 1 |
| 4902 | MVLNT | 1 |
| 4903 | MVLRG | 1 |
| 4904 | MVLVT | 1 |
| 4905 | MVVAS | 1 |
| 4906 | NDALQYD | 1 |
| 4907 | NDALQYESECGP | 1 |
| 4908 | NELLR | 1 |
| 4909 | NELMR | 1 |
| 4910 | NELRV | 1 |
| 4911 | NGLG | 1 |
| 4912 | NGLIVHIRSHTGERPF | 1 |
|  | NGR | 1 |
| 4913 | NGRPPG*E | 1 |
| 4914 | NGRSPVR | 1 |
| 4915 | NILMG | 1 |
| 4916 | NKLAR | 1 |
| 4917 | NKLRA | 1 |
| 4918 | NKLRG | 1 |
| 4919 | NKLVA | 1 |
| 4920 | NKLVK | 1 |
| 4921 | NMLGV | 1 |
| 4922 | NNLIN | 1 |
| 1838 | NRLRE | 1 |
| 4923 | NRLRI | 1 |
| 4924 | NSLV | 1 |
| 4925 | NSLVA | 1 |
| 4926 | NVHP*VVGLAA | 1 |
| 4927 | NVLGE | 1 |
| 4928 | PALAG | 1 |
| 4929 | PALGP | 1 |
| 4930 | PALV | 1 |
| 4931 | PASV | 1 |
| 4932 | PDLRA | 1 |
| 4933 | PGITE | 1 |
| 4934 | PGLAP | 1 |
| 4935 | PGLHE | 1 |
| 4936 | PGVAA | 1 |
| 4937 | PGVVP | 1 |
| 4938 | PHLKR | 1 |
| 4939 | PKLIF | 1 |
| 4940 | PLRG | 1 |
| 4941 | PMLAG | 1 |
| 4942 | PMLTM | 1 |
| 4943 | PNLAS | 1 |
| 3786 | PNLAV | 1 |
| 3919 | PNYW | 1 |
| 4944 | PNYWS | 1 |
| 4945 | PQLVV | 1 |
| 4946 | PQSRG*RG | 1 |
| 4947 | PR*GA | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 4948 | PRLRL | 1 |
| 4949 | PSFQ | 1 |
| 4950 | PTLAK | 1 |
| 4951 | PVLKV | 1 |
| 4952 | PVLMT | 1 |
| 2602 | QALKR | 1 |
| 4953 | QALRG | 1 |
| 4954 | QALSP | 1 |
| 4955 | QGLHL | 1 |
| 3675 | QGLPV | 1 |
| 4956 | QILLQ QILLRHIRSHT | 1 |
| 4957 | GERPF | 1 |
| 4958 | QILLY | 1 |
| 4959 | QILPE | 1 |
| 4960 | QMLAR | 1 |
| 4961 | QPLAV | 1 |
| 4962 | QPLTM | 1 |
| 4963 | QRLGG | 1 |
| 4964 | QTLAV | 1 |
| 4965 | QTLGG | 1 |
| 4966 | QTLGP | 1 |
| 4967 | REIVR | 1 |
| 4968 | RELRR | 1 |
| 4969 | RGLAA | 1 |
| 4970 | RGLDN | 1 |
| 4971 | RGLNS | 1 |
| 4972 | RGLRS | 1 |
| 4973 | RGLTG | 1 |
| 4974 | RGLVE | 1 |
| 4975 | RGYGT RHE | 1 1 |
| 4976 | RHLKM | 1 |
| 4977 | RLLGL | 1 |
| 4978 | RP*SG | 1 |
| 4979 | RPLAG | 1 |
| 4980 | RQLGK | 1 |
| 4981 | RQLLE | 1 |
| 4982 | RRLEA | 1 |
| 4983 | RRLET | 1 |
| 2126 | RRLGD | 1 |
| 4984 | RRLGS | 1 |
| 4985 | RRLSE | 1 |
| 4986 | RRLTP | 1 |
| 4987 | RRVVG RSH | 1 1 |
| 4988 | RTLKL | 1 |
| 4989 | RTLVG | 1 |
| 4990 | RVLEP | 1 |
| 4991 | RVLRE SC**A | 1 1 |
| 4992 | SCLK | 1 |
| 4993 | SGILV | 1 |
| 4994 | SGLGG | 1 |
| 4995 | SGLGL | 1 |
| 4996 | SGLGT | 1 |
| 4997 | SGLLG | 1 |
| 4998 | SGLNL | 1 |
| 4999 | SGLRL | 1 |
| 5000 | SGLVG | 1 |
| 3331 | SHLRL | 1 |
| 3425 | SKLIL | 1 |
| 2438 | SKLKA | 1 |
| 3722 | SKLKG | 1 |
| 5001 | SKLLG | 1 |
| 3334 | SKLRI | 1 |
| 2191 | SKLRM | 1 |
| 3337 | SKLVL | 1 |
| 5002 | SL*HG | 1 |
| 5003 | SLLRT | 1 |
| 5004 | SNLTY | 1 |
| 5005 | SNYWP | 1 |
| 5006 | SPLIG | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 5007 | SPLKI | 1 |
| 5008 | SPLRN | 1 |
| 2138 | SQLKV | 1 |
| 5009 | SQMK | 1 |
|  | SR*G | 1 |
| 1857 | SRLKV | 1 |
| 5010 | SRLMT | 1 |
| 5011 | SRLVT | 1 |
| 5012 | SSLGA | 1 |
| 5013 | SSLGL | 1 |
| 5014 | STLQK | 1 |
| 5015 | SVLVG | 1 |
| 5016 | SVLVS | 1 |
|  | T | 1 |
| 5017 | TALEA | 1 |
| 5018 | TALKG | 1 |
| 5019 | TELE | 1 |
| 5020 | TELIR | 1 |
| 5021 | TELPR | 1 |
| 5022 | TELRV | 1 |
| 5023 | TGLAD | 1 |
| 5024 | TGLGA | 1 |
| 5025 | THLAN | 1 |
| 5026 | THLAV | 1 |
| 3318 | THLRK | 1 |
| 3808 | TKIRV | 1 |
| 3785 | TKLKA | 1 |
| 5027 | TKLLR | 1 |
| 5028 | TKLME | 1 |
| 3802 | TKLNV | 1 |
| 3955 | TKLR | 1 |
| 3783 | TKLRA | 1 |
| 3361 | TKLRI | 1 |
| 5029 | TKLRR | 1 |
| 5030 | TKLVL | 1 |
| 5031 | TKSGV | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 5032 | TLIS | 1 |
| 5033 | TLLIR | 1 |
| 5034 | TLLM | 1 |
| 5035 | TLLMQ | 1 |
| 5036 | TLNG | 1 |
| 5037 | TLQP | 1 |
| 5038 | TMLDP | 1 |
| 5039 | TMLRE | 1 |
| 5040 | TNLVG | 1 |
| 5041 | TPLIV | 1 |
| 5042 | TPLMQ | 1 |
| 5043 | TPLSD | 1 |
| 5044 | TPLSI | 1 |
| 5045 | TQLED | 1 |
| 5046 | TRLGA | 1 |
| 5047 | TRLMI | 1 |
| 5048 | TRLRL | 1 |
| 1883 | TRLRV | 1 |
| 5049 | TRLTG | 1 |
| 5050 | TSLSE | 1 |
| 5051 | TTLEP | 1 |
| 5052 | TTLGV | 1 |
| 1849 | TTLKV | 1 |
| 1919 | TTLRV | 1 |
| 5053 | TVLGG | 1 |
| 5054 | TVLT | 1 |
|  | V*KS | 1 |
| 5055 | VALHT | 1 |
| 5056 | VDLLL | 1 |
| 5057 | VELAP | 1 |
| 5058 | VELN | 1 |
| 5059 | VELNN | 1 |
| 5060 | VELRV | 1 |
| 5061 | VGLPV | 1 |
| 5062 | VGLQA | 1 |
| 2652 | VGLQR | 1 |

TABLE 21-continued

ZF4
selection on G:A
change at nt 10 of core motif in CBS.
Sequences reflect position 2 to 6.

| SEQ ID NO: | Sequence | Read # |
|---|---|---|
| 5063 | VGLRN | 1 |
| 5064 | VGLRV | 1 |
| 5065 | VGLSP | 1 |
| 5066 | VGLSQ | 1 |
| 5067 | VHLAL | 1 |
| 5068 | VKLMA | 1 |
| 5069 | VKLQN | 1 |
| 3765 | VKLRL | 1 |
| 5070 | VLLAA | 1 |
| 5071 | VLLIE | 1 |
| 5072 | VLLKI | 1 |
| 5073 | VLLTP | 1 |
| 5074 | VLMV | 1 |
| 5075 | VLQR | 1 |
| 5076 | VMLRG | 1 |
| 3772 | VPLAL | 1 |
| 5077 | VPLVG | 1 |
| 5078 | VQLPM | 1 |
| 5079 | VQLRV | 1 |
| 5080 | VRLEG | 1 |
| 5081 | VRLGG | 1 |
| 3778 | VRLQA | 1 |
| 5082 | VRLVR | 1 |
|  | VTG | 1 |
| 5083 | VTLER | 1 |
| 5084 | VTLGS | 1 |
|  | WRN | 1 |

TABLE 22

ZF4
selection on G:A
change at nt 11 of core motif in CBS.
Sequences reflect position 2 to 6.

| SEQ ID NO: | Sequence | Read # |
|---|---|---|
| 118 | GNLRR | 3407 |
| 69 | ANLRR | 1937 |

TABLE 22-continued

ZF4
selection on G:A
change at nt 11 of core motif in CBS.
Sequences reflect position 2 to 6.

| SEQ ID NO: | Sequence | Read # |
|---|---|---|
| 117 | GNLVR | 1794 |
| 116 | SNLRR | 1771 |
| 5085 | SNLKR | 1208 |
| 68 | TNLRR | 862 |
| 119 | GNLKR | 850 |
| 138 | GNLAR | 805 |
| 2582 | SNLVR | 764 |
| 2609 | GNLQR | 562 |
| 70 | GNLTR | 531 |
| 121 | NNLRR | 486 |
| 2914 | GNLIR | 475 |
| 2494 | ANLVR | 455 |
| 2706 | GNLNR | 373 |
| 2517 | GNLLR | 360 |
| 2620 | ANLKR | 326 |
| 2524 | SNLAR | 269 |
| 2963 | SNLQR | 261 |
| 139 | GNLMR | 251 |
| 2695 | SNLMR | 228 |
| 2746 | GNLHR | 220 |
| 5086 | SNLTR | 209 |
| 5087 | NNLKR | 202 |
| 5088 | SNLIR | 199 |
| 5089 | ANLMR | 191 |
| 2621 | ANLNR | 179 |
| 74 | TMLRR | 158 |
| 5090 | SNLNR | 155 |
| 5091 | ANLTR | 136 |
| 5092 | ANLQR | 125 |
| 2595 | TNLKR | 118 |
| 73 | AMLRR | 111 |
| 2567 | GNLSR | 107 |
| 2542 | ANLAR | 102 |
| 66 | ATLRR | 96 |

TABLE 22-continued

ZF4 selection on G:A change at nt 11 of core motif in CBS. Sequences reflect position 2 to 6.

| SEQ ID NO: | Sequence | Read # |
|---|---|---|
| 2558 | HNLRR | 90 |
| 2538 | AALRR | 81 |
| 2496 | SNLLR | 77 |
| 5093 | ANLER | 73 |
| 2556 | SMLRR | 62 |
| 5094 | ANLHR | 59 |
| 5095 | ANLLR | 58 |
| 3032 | SMLKR | 51 |
| 2544 | SNLSR | 47 |
| 2541 | TNLQR | 47 |
| 2521 | GALKR | 44 |
| 2641 | GALRR | 44 |
| 3347 | AHLRR | 42 |
| 2823 | HMLRR | 40 |
| 2047 | HMLKR | 36 |
| 5096 | RNLQR | 35 |
| 71 | AMLKR | 31 |
| 2722 | GMLKR | 31 |
| 3161 | GMLRR | 29 |
| 2131 | SALKR | 28 |
| 5097 | SNLER | 26 |
| 5098 | KNLQR | 25 |
| 5099 | RNLRR | 24 |
| 2584 | GTLRR | 21 |
| 2978 | TMLKR | 21 |
| 2481 | GNLER | 20 |
| 5100 | QNLKR | 19 |
| 67 | RRLDR | 19 |
| 2638 | STLRR | 19 |
| 2526 | TNLNR | 17 |
| 2575 | QNLRR | 16 |
| 2523 | SALRR | 16 |
| 2714 | TNLHR | 16 |
| 2551 | ANLIR | 15 |
| 1985 | AALKR | 14 |
| 48 | ATLKR | 14 |
| 2875 | ASLRR | 13 |
| 2587 | NTLRR | 13 |
| 2511 | TNLVR | 13 |
| 3330 | GHLRR | 12 |
| 2691 | NNLMR | 12 |
| 2617 | TALKR | 12 |
| 5101 | KNLER | 11 |
| 2518 | NNLVR | 11 |
| 3403 | THLRR | 11 |
| 5102 | SMLQR | 10 |
| 2561 | TNLMR | 10 |
| 2737 | TTLRR | 10 |
| 2475 | AGLRR | 9 |
| 2622 | ATLTR | 9 |
| 3050 | HNLKR | 9 |
| 5103 | KNLVR | 9 |
| 2464 | SGLRR | 9 |
| 2769 | VNLRR | 9 |
| 5104 | AMLTR | 8 |
| 2882 | AVLRR | 8 |
| 3393 | GHLKR | 8 |
| 5105 | TNLTR | 8 |
| 3017 | ATLNR | 7 |
| 2739 | ATLVR | 7 |
| 5106 | HNLMR | 7 |
| 2734 | TALRR | 7 |
| 4308 | TNLLR | 7 |
| 5107 | AMLQR | 6 |
| 52 | ANLSR | 6 |
| 2509 | ASLKR | 6 |
| 2876 | ASLTR | 6 |
| 2801 | ATLMR | 6 |
| 5108 | GMLER | 6 |

TABLE 22-continued

ZF4 selection on G:A change at nt 11 of core motif in CBS. Sequences reflect position 2 to 6.

| SEQ ID NO: | Sequence | Read # |
|---|---|---|
| 5109 | RLLIN | 6 |
| 5110 | SGLLK | 6 |
| 2649 | TNLAR | 6 |
| 5111 | AHLVR | 5 |
| 3012 | ATLHR | 5 |
| 2881 | ATLQR | 5 |
| 2599 | ENLRR | 5 |
| 3084 | HMLQR | 5 |
| 72 | HMLTR | 5 |
| 5112 | ISLRV | 5 |
| 2543 | NNLAR | 5 |
| 3205 | SNLHR | 5 |
| 2153 | STLKR | 5 |
| 5113 | AHLKR | 4 |
| 2879 | ATLIR | 4 |
| 2623 | DNLRR | 4 |
| 2592 | GALTR | 4 |
| 5114 | GNLRK | 4 |
| 5115 | KKLLR | 4 |
| 5116 | MNLRR | 4 |
| 5117 | MVLLR | 4 |
| 5118 | NNLQR | 4 |
| 5119 | QNLVR | 4 |
| 5120 | RNLAR | 4 |
| 3396 | SHLRR | 4 |
| 2962 | SMLHR | 4 |
| 2679 | TNLER | 4 |
| 5121 | TVLLV | 4 |
| 2738 | AALNR | 3 |
| 2770 | AALVR | 3 |
| 1986 | AGLKR | 3 |
| 2539 | ETLRR | 3 |
| 3159 | GHLQR | 3 |
| 3449 | GHLVR | 3 |
| 5122 | GMLNR | 3 |
| 5123 | GMLTR | 3 |
| 5124 | GMLVR | 3 |
| 2608 | GNLGR | 3 |
| 5125 | GNLRG | 3 |
| 5126 | GNLVK | 3 |
| 2600 | GSLRR | 3 |
| 2554 | GTLKR | 3 |
| 56 | HTLRR | 3 |
| 3010 | HVLRR | 3 |
| 5127 | KNLRR | 3 |
| 5128 | MNLKR | 3 |
| 3407 | NGRSPV... | 3 |
| 2712 | NMLRR | 3 |
| 2757 | PNLIR | 3 |
| 3370 | QHLRR | 3 |
| 2956 | SALNR | 3 |
| 5129 | STLEV | 3 |
| 2967 | STLNR | 3 |
| 5130 | TALRS | 3 |
| 1305 | THLKR | 3 |
| 5131 | TNLIR | 3 |
| 2700 | AALTR | 2 |
| 5132 | AMLNR | 2 |
| 5133 | ANLRL | 2 |
| 5134 | ANLRW | 2 |
| 2654 | ATLAR | 2 |
| 5135 | DALLV | 2 |
| 2528 | GGLIR | 2 |
| 4764 | GILAR | 2 |
| 3160 | GILRR | 2 |
|  | GN*S... | 2 |
| 2522 | GNLDR | 2 |
| 5136 | GNLNK | 2 |
| 5137 | GNLRP | 2 |
| 5138 | GNLRS | 2 |

TABLE 22-continued

ZF4
selection on G:A
change at nt 11 of
core motif in CBS.
Sequences reflect
position 2 to 6.

| SEQ ID NO: | Sequence | Read # |
|---|---|---|
| 5139 | GTLIR | 2 |
| 3081 | GTLMR | 2 |
| 2626 | GTLVR | 2 |
| 5140 | HGLET | 2 |
| 5141 | HMLNR | 2 |
| 2644 | HNLVR | 2 |
| 5142 | KNLMR | 2 |
| 2637 | NNLLR | 2 |
| 2756 | NSLRR | 2 |
| 5143 | PGLLG | 2 |
| 5144 | RNLVR | 2 |
| 5145 | SMLNR | 2 |
| 2677 | SMLTR | 2 |
| 2487 | SNLDR | 2 |
| 2850 | STLMR | 2 |
| 2970 | SVLRR | 2 |
| 2462 | TGLRR | 2 |
| 5146 | TMLQR | 2 |
| 2766 | TSLKR | 2 |
| 2860 | TTLKR | 2 |
| 3075 | TVLRR | 2 |
| 5147 | AALRS | 1 |
| 5148 | ADLER | 1 |
| 3089 | ADLVR | 1 |
| 2798 | AGLMR | 1 |
| 1431 | AHLTR | 1 |
| 2871 | AILTR | 1 |
| 5149 | AMLAR | 1 |
| 5150 | AMLHR | 1 |
| 5151 | AMLIR | 1 |
| 5152 | ANFRR | 1 |
| 5153 | ANIQR | 1 |
| 5154 | ANLDR | 1 |
| 2771 | ANLGR | 1 |
| 5155 | ANLVG | 1 |
| 5156 | ANSRR | 1 |
| 5157 | ANVRR | 1 |
| 5158 | APLRR | 1 |
| 2799 | ASLQR | 1 |
| 2880 | ATLLR | 1 |
| 5159 | ATLRS | 1 |
| 5160 | AYFRR | 1 |
| 5161 | CNLAR | 1 |
| 5162 | CNLNR | 1 |
| 5163 | CNLVR | 1 |
| 2591 | DNLKR | 1 |
| 2506 | DNLVR | 1 |
| 2778 | GALNR | 1 |
| 3035 | GDLAR | 1 |
| 2816 | GDLRR | 1 |
| 2780 | GDLTR | 1 |
| 2027 | GGLKR | 1 |
| 2461 | GGLRR | 1 |
| 2909 | GGVRR | 1 |
| 5164 | GHLNR | 1 |
| 5165 | GNFRR | 1 |
| 5166 | GNFVG | 1 |
| 5167 | GNLAG | 1 |
| 5168 | GNLAS | 1 |
| 5169 | GNLHK | 1 |
| 5170 | GNLLS | 1 |
| 5171 | GNLMS | 1 |
| 5172 | GNLNH | 1 |
| 5173 | GNLQS | 1 |
| 5174 | GNLRH | 1 |
| 5175 | GNLS... | 1 |
| 5176 | GNLTK | 1 |
| 5177 | GNLTQ | 1 |
| 5178 | GNLTW | 1 |

TABLE 22-continued

ZF4 selection on G:A change at nt 11 of core motif in CBS. Sequences reflect position 2 to 6.

| SEQ ID NO: | Sequence | Read # |
|---|---|---|
| 5179 | GNLVW | 1 |
| 5180 | GNLWR | 1 |
| 5181 | GNSKR | 1 |
| 5182 | GNSQR | 1 |
| 5183 | GNSRR | 1 |
| 5184 | GNVQR | 1 |
| 5185 | GNVTR | 1 |
| 5186 | GQLAL | 1 |
| 2819 | GSLKR | 1 |
| 2747 | GTLNR | 1 |
| 5187 | GY*LR | 1 |
| 2661 | HNLAR | 1 |
| 2752 | HNLQR | 1 |
| 5188 | ITLQR | 1 |
| 5189 | KILGN | 1 |
| 5190 | KNLKR | 1 |
| 1356 | KNLTR | 1 |
| 5191 | KSLRR | 1 |
| 5192 | LNLRR | 1 |
| 5193 | LNLVR | 1 |
| 2664 | NMLKR | 1 |
| 2690 | NNLIR | 1 |
| 5194 | NNLNR | 1 |
| 2726 | NNLTR | 1 |
| 5195 | NNSRR | 1 |
| 2788 | NTLAR | 1 |
| 2939 | NTLIR | 1 |
| 2628 | NTLKR | 1 |
| 2940 | NTLNR | 1 |
| 5196 | PRLRG | 1 |
| 5197 | QHLKR | 1 |
| 2574 | QMLKR | 1 |
| 2593 | QTLRR | 1 |
| 5198 | RLIIN | 1 |
| 5199 | RNLKR | 1 |
| 3292 | SALQR | 1 |
| 2559 | SGLKR | 1 |
| 5200 | SHLKR | 1 |
| 3202 | SILNR | 1 |
| 5201 | SKLTR | 1 |
| 2647 | SMLIR | 1 |
| 5202 | SMLVR | 1 |
| 5203 | SNLFR | 1 |
| 5204 | SNLIH | 1 |
| 5205 | SNLRK | 1 |
| 5206 | SNLRQ | 1 |
| 5207 | SNLSG | 1 |
| 5208 | SNLTS | 1 |
| 5209 | SNLVW | 1 |
| 5210 | SNSRR | 1 |
| 5211 | SNVKR | 1 |
| 5212 | SNVRG | 1 |
| 2698 | STLVR | 1 |
| 5213 | TMFRR | 1 |
| 3109 | TMLNR | 1 |
| 2680 | TNLGR | 1 |
| 5214 | TNLLS | 1 |
| 5215 | TPTRS | 1 |
| 5216 | TQLVL | 1 |
| 2589 | TSLRR | 1 |
| 5217 | VNLTR | 1 |
| 2997 | VTLRR | 1 |

TABLE 23

ZF4 selection on G:C change at nt 11 of core motif in CBS. Sequences reflect position 2 to 6.

| SEQ ID NO: | Sequence | Read # |
|---|---|---|
| 73 | AMLRR | 3064 |
| 74 | TMLRR | 2212 |
| 2556 | SMLRR | 1556 |
| 3161 | GMLRR | 1320 |
| 2722 | GMLKR | 1160 |
| 3032 | SMLKR | 1049 |
| 71 | AMLKR | 797 |
| 2978 | TMLKR | 515 |
| 2823 | HMLRR | 478 |
| 2047 | HMLKR | 429 |
| 66 | ATLRR | 261 |
| 5102 | SMLQR | 248 |
| 5107 | AMLQR | 212 |
| 5132 | AMLNR | 125 |
| 5104 | AMLTR | 124 |
| 5146 | TMLQR | 123 |
| 2712 | NMLRR | 119 |
| 2664 | NMLKR | 102 |
| 2677 | SMLTR | 98 |
| 72 | HMLTR | 93 |
| 5123 | GMLTR | 88 |
| 5150 | AMLHR | 72 |
| 5122 | GMLNR | 68 |
| 2962 | SMLHR | 63 |
| 5145 | SMLNR | 59 |
| 48 | ATLKR | 58 |
| 5124 | GMLVR | 50 |
| 5141 | HMLNR | 47 |
| 3084 | HMLQR | 47 |
| 5149 | AMLAR | 46 |
| 5218 | AMLVR | 45 |
| 3109 | TMLNR | 38 |
| 5219 | GMLHR | 34 |
| 5202 | SMLVR | 34 |
| 2533 | SMLAR | 29 |

TABLE 23-continued

ZF4 selection on G:C change at nt 11 of core motif in CBS. Sequences reflect position 2 to 6.

| SEQ ID NO: | Sequence | Read # |
|---|---|---|
| 2638 | STLRR | 27 |
| 2970 | SVLRR | 27 |
| 67 | RRLDR | 26 |
| 118 | GNLRR | 24 |
| 2737 | TTLRR | 24 |
| 2882 | AVLRR | 23 |
| 5151 | AMLIR | 22 |
| 2913 | GMLAR | 22 |
| 5220 | GMLQR | 22 |
| 2584 | GTLRR | 19 |
| 2875 | ASLRR | 18 |
| 5221 | HMLAR | 17 |
| 2587 | NTLRR | 17 |
| 69 | ANLRR | 16 |
| 2713 | QMLRR | 16 |
| 3017 | ATLNR | 15 |
| 2574 | QMLKR | 15 |
| 5222 | RRLKN | 15 |
| 5223 | AMLMR | 14 |
| 2801 | ATLMR | 14 |
| 5224 | GMLIR | 14 |
| 5225 | EMLRR | 13 |
| 117 | GNLVR | 13 |
| 5226 | RTLAL | 13 |
| 5227 | SMLSR | 13 |
| 116 | SNLRR | 13 |
| 2647 | SMLIR | 12 |
| 1986 | AGLKR TRS | 11 11 |
| 2739 | ATLVR TRS... | 10 10 |
| 2538 | AALRR | 9 |
| 3012 | ATLHR | 9 |
| 2582 | SNLVR | 9 |
| 5228 | TMLTR | 9 |

TABLE 23-continued

ZF4 selection on G:C change at nt 11 of core motif in CBS. Sequences reflect position 2 to 6.

| SEQ ID NO: | Sequence | Read # |
|---|---|---|
| 68 | TNLRR | 9 |
| 5229 | TMLVR | 8 |
| 3075 | TVLRR | 8 |
| 2027 | GGLKR | 7 |
| 2914 | GNLIR | 7 |
| 2609 | GNLQR | 7 |
| 3407 | NGRSPV... | 7 |
| 2559 | SGLKR | 7 |
| 5230 | TMLMR | 7 |
| 2860 | TTLKR | 7 |
| 2881 | ATLQR | 6 |
| 2622 | ATLTR | 6 |
| 5231 | GMLMR | 6 |
| 70 | GNLTR | 6 |
| 2554 | GTLKR | 6 |
| 5085 | SNLKR | 6 |
| 2965 | SSLKR | 6 |
| 5232 | AMLER | 5 |
| 5233 | AMVRR | 5 |
| 2494 | ANLVR | 5 |
| 119 | GNLKR | 5 |
| 5086 | SNLTR | 5 |
| 5234 | TMLAR | 5 |
| 3987 | VELNS | 5 |
| 2654 | ATLAR | 4 |
| 2879 | ATLIR | 4 |
| 2606 | EMLKR | 4 |
| 138 | GNLAR | 4 |
| 139 | GNLMR | 4 |
| 5087 | NNLKR | 4 |
| 5235 | SMLMR | 4 |
| 2153 | STLKR | 4 |
| 2462 | TGLRR | 4 |
| 5093 | ANLER | 3 |
| 2620 | ANLKR | 3 |

TABLE 23-continued

ZF4 selection on G:C change at nt 11 of core motif in CBS. Sequences reflect position 2 to 6.

| SEQ ID NO: | Sequence | Read # |
|---|---|---|
| 2621 | ANLNR | 3 |
| 5092 | ANLQR | 3 |
| 2509 | ASLKR | 3 |
| 2520 | DMLRR | 3 |
| 2641 | GALRR | 3 |
| 2706 | GNLNR | 3 |
| 5236 | HLLRR | 3 |
| 5237 | HMLHR | 3 |
| 3010 | HVLRR | 3 |
| 5238 | KTLRR LL... | 3 3 |
| 121 | NNLRR | 3 |
| 2477 | SGLTR | 3 |
| 5239 | SMLKN | 3 |
| 3203 | SMLLR | 3 |
| 2963 | SNLQR | 3 |
| 2967 | STLNR | 3 |
| 1985 | AALKR | 2 |
| 2738 | AALNR | 2 |
| 3516 | ALLRR | 2 |
| 5240 | AMLLR | 2 |
| 5241 | AMLRH | 2 |
| 5242 | AMLRS | 2 |
| 5243 | AMLRW | 2 |
| 5244 | AMLSR | 2 |
| 5094 | ANLHR | 2 |
| 2802 | AVLKR | 2 |
| 5108 | GMLER | 2 |
| 5245 | GMLKN | 2 |
| 5246 | GMLRW | 2 |
| 5247 | GMVRR | 2 |
| 2600 | GSLRR | 2 |
| 2921 | GVLRR | 2 |
| 3039 | HILKR | 2 |
| 5248 | HILRR | 2 |

TABLE 23-continued

ZF4 selection on G:C change at nt 11 of core motif in CBS. Sequences reflect position 2 to 6.

| SEQ ID NO: | Sequence | Read # |
|---|---|---|
| 5249 | HMLRS | 2 |
| 3040 | HMLVR | 2 |
| 2558 | HNLRR | 2 |
| 56 | HTLRR | 2 |
| 5250 | MGLST | 2 |
| 5251 | NMLIR | 2 |
| 2628 | NTLKR | 2 |
| 2593 | QTLRR | 2 |
| 5252 | RMLKR | 2 |
| 5253 | RMLQR | 2 |
|  | RN*P... | 2 |
| 5254 | SMFKR | 2 |
| 2524 | SNLAR | 2 |
| 2850 | STLMR | 2 |
| 5255 | TLLRR | 2 |
| 5256 | TMIRR | 2 |
| 5257 | TMVRR | 2 |
| 5258 | VIKR... | 2 |
| 5259 | AKLQR | 1 |
| 3062 | ALLKR | 1 |
| 5260 | AMFRR | 1 |
| 5261 | AMIRR | 1 |
| 5262 | AMITR | 1 |
| 5263 | AMKTR | 1 |
| 5264 | AMLCR | 1 |
| 5265 | AMLHS | 1 |
| 5266 | AMLPR | 1 |
| 4674 | AMLR... | 1 |
| 3519 | AMLRG | 1 |
| 5267 | AMLRK | 1 |
| 5268 | AMLTM | 1 |
| 5269 | AMLWR | 1 |
| 5270 | AMYT... | 1 |
| 2542 | ANLAR | 1 |
| 5271 | ARLRR | 1 |
| 4682 | ARLRS | 1 |
| 1947 | ARLRV | 1 |
| 3251 | ASLNR | 1 |
| 2878 | ATLER | 1 |
| 3025 | ATLGR | 1 |
| 5159 | ATLRS | 1 |
| 2772 | ATLSR | 1 |
| 5272 | CMLRR | 1 |
| 2640 | DMLKR | 1 |
| 3078 | DMLQR | 1 |
| 5273 | DMVKR | 1 |
| 5274 | EMLNS | 1 |
| 2539 | ETLRR | 1 |
| 5275 | GLLKR | 1 |
| 5276 | GLLQS | 1 |
| 5277 | GLLSR | 1 |
| 5278 | GMIKR | 1 |
| 5279 | GMLKT | 1 |
| 5280 | GMLRM | 1 |
| 5281 | GMLTW | 1 |
| 2746 | GNLHR | 1 |
| 2517 | GNLLR | 1 |
| 5282 | GRLKR | 1 |
| 5283 | GRLKS | 1 |
| 5284 | GRLRV | 1 |
| 2747 | GTLNR | 1 |
| 2626 | GTLVR | 1 |
| 3001 | GVLKR | 1 |
| 2483 | HALRR | 1 |
| 2531 | HLLKR | 1 |
| 5285 | HLLNS... | 1 |
| 5286 | HMLLR | 1 |
| 5287 | HMLMR | 1 |
| 5288 | HMVRR | 1 |

TABLE 23-continued

ZF4 selection on G:C change at nt 11 of core motif in CBS. Sequences reflect position 2 to 6.

| SEQ ID NO: | Sequence | Read # |
|---|---|---|
| 5106 | HNLMR | 1 |
| 2784 | HVLKR | 1 |
| 5189 | KILGN | 1 |
| 5289 | KMLKR | 1 |
| 5290 | LMLGK | 1 |
| 5291 | MLRR | 1 |
| 5292 | NLLKR | 1 |
| 5293 | NMLGR | 1 |
| 5294 | NTFRR | 1 |
| 2939 | NTLIR | 1 |
| 2940 | NTLNR | 1 |
| 5295 | PMLMR | 1 |
| 5296 | PVVKR | 1 |
| 2692 | QSLKR | 1 |
| 5297 | RMFRR | 1 |
| 5298 | RMLRR | 1 |
| 2956 | SALNR | 1 |
| 2523 | SALRR | 1 |
| 2464 | SGLRR | 1 |
| 3004 | SILKR | 1 |
| 3470 | SKLKR | 1 |
| 5201 | SKLTR | 1 |
| 5299 | SLLNR | 1 |
| 5300 | SMFRR | 1 |
| 5301 | SMIKR | 1 |
| 5302 | SMLGR | 1 |
| 5303 | SMLKW | 1 |
| 5304 | SMSRR | 1 |
| 5305 | SMVKR | 1 |
| 2496 | SNLLR | 1 |
| 5090 | SNLNR | 1 |
| 2792 | SQLKR | 1 |
| 1876 | SRLKR | 1 |
| 5306 | SRLRR | 1 |
| 2845 | SSLAR | 1 |
| 2698 | STLVR | 1 |
| 2699 | SVLKR | 1 |
| 5307 | TILRR | 1 |
| 5308 | TMLER | 1 |
| 5309 | TMLGR | 1 |
| 5310 | TMLHR | 1 |
| 5311 | TMLLR | 1 |
| 5312 | TMLRH | 1 |
| 5313 | TMLWR | 1 |
| 2595 | TNLKR | 1 |
| 2856 | TNLSR | 1 |
| 5215 | TPTRS | 1 |
| 5314 | VMLKR | 1 |
| 5315 | VSLRK | 1 |
| 2997 | VTLRR | 1 |
| 5316 | WMLKR | 1 |
| 5317 | WMLRR | 1 |
| 5318 | YMLKR | 1 |
| 5319 | YMLRR | 1 |

TABLE 24

ZF4 selection on G:T change at nt 11 of core motif in CBS. Sequences reflect position 2 to 6.

| SEQ ID NO: | Sequence | Read # |
|---|---|---|
| 66 | ATLRR | 6399 |
| 67 | RRLDR | 1155 |
| 2584 | GTLRR | 1073 |
| 2737 | TTLRR | 1024 |
| 2638 | STLRR | 970 |
| 3017 | ATLNR | 770 |
| 2739 | ATLVR | 727 |

TABLE 24-continued

ZF4 selection on G:T change at nt 11 of core motif in CBS. Sequences reflect position 2 to 6.

| SEQ ID NO: | Sequence | Read # |
|---|---|---|
| 48 | ATLKR | 708 |
| 2587 | NTLRR | 670 |
| 2538 | AALRR | 657 |
| 2801 | ATLMR | 456 |
| 2654 | ATLAR | 418 |
| 2554 | GTLKR | 399 |
| 2875 | ASLRR | 366 |
| 2622 | ATLTR | 363 |
| 2593 | QTLRR | 298 |
| 2539 | ETLRR | 292 |
| 2881 | ATLQR | 291 |
| 2879 | ATLIR | 261 |
| 2153 | STLKR | 252 |
| 2628 | NTLKR | 237 |
| 56 | HTLRR | 227 |
| 2882 | AVLRR | 208 |
| 2880 | ATLLR | 171 |
| 1985 | AALKR | 141 |
| 2878 | ATLER | 134 |
| 3012 | ATLHR | 130 |
| 2860 | TTLKR | 125 |
| 2509 | ASLKR | 95 |
| 73 | AMLRR | 93 |
| 3010 | HVLRR | 81 |
| 2523 | SALRR | 63 |
| 5248 | HILRR | 60 |
| 74 | TMLRR | 59 |
| 2967 | STLNR | 58 |
| 2131 | SALKR | 47 |
| 2738 | AALNR | 46 |
| 2483 | HALRR | 44 |
| 2641 | GALRR | 41 |
| 2843 | QTLKR | 41 |
| 2783 | HTLKR | 39 |
| 3032 | SMLKR | 39 |
| 1930 | HALKR | 36 |
| 2970 | SVLRR | 36 |
| 2802 | AVLKR | 35 |
| 2556 | SMLRR | 34 |
| 3161 | GMLRR | 33 |
| 2722 | GMLKR | 31 |
| 2850 | STLMR | 31 |
| 2698 | STLVR | 31 |
| 2626 | GTLVR | 28 |
| 2521 | GALKR | 27 |
| 2747 | GTLNR | 27 |
| 2590 | TTLQR | 27 |
| 2921 | GVLRR | 25 |
| 118 | GNLRR | 24 |
| 116 | SNLRR | 24 |
| 2589 | TSLRR | 24 |
| 69 | ANLRR | 23 |
| 2997 | VTLRR | 23 |
| 2700 | AALTR | 22 |
| 71 | AMLKR | 22 |
| 2697 | STLQR | 22 |
| 5320 | ATLRK | 21 |
| 117 | GNLVR | 21 |
| 2823 | HMLRR | 20 |
| 2772 | ATLSR | 17 |
| 5321 | RTLQR | 17 |
| 2734 | TALRR | 17 |
| 2819 | GSLKR | 16 |
| 3018 | STLIR | 16 |
| 2717 | AALQR | 15 |
| 2800 | ASLVR | 15 |
| 2849 | STLHR | 15 |
| 2489 | SSLRR | 14 |
| 2978 | TMLKR | 14 |

TABLE 24-continued

ZF4 selection on G:T change at nt 11 of core motif in CBS. Sequences reflect position 2 to 6.

| SEQ ID NO: | Sequence | Read # |
|---|---|---|
| 3075 | TVLRR | 14 |
| 2876 | ASLTR | 13 |
| 3081 | GTLMR | 13 |
| 2047 | HMLKR | 13 |
| 2966 | STLLR | 13 |
| 2762 | STLTR | 13 |
| 2681 | TTLNR | 13 |
| 70 | GNLTR | 12 |
| 5189 | KILGN | 12 |
| 68 | TNLRR | 11 |
| 3864 | ARLRI | 10 |
| 2502 | ETLKR | 10 |
| 2600 | GSLRR | 10 |
| 2684 | GTLAR | 10 |
| 5322 | KTLER | 10 |
| 5323 | QTLMR | 10 |
| 3028 | SILRR | 10 |
| 5085 | SNLKR | 10 |
| 2617 | TALKR | 10 |
| 2799 | ASLQR | 9 |
| 3001 | GVLKR | 9 |
| 121 | NNLRR | 9 |
| 2877 | ATLDR | 8 |
| 138 | GNLAR | 8 |
| 2914 | GNLIR | 8 |
| 5324 | KTLQR | 8 |
| 5325 | RTLRR | 8 |
| 5102 | SMLQR | 8 |
| 2965 | SSLKR | 8 |
| 1947 | ARLRV | 7 |
| 2607 | GALVR | 7 |
| 5139 | GTLIR | 7 |
| 2784 | HVLKR | 7 |
| 3067 | MTLRR | 7 |
| 5086 | SNLTR | 7 |
| 2582 | SNLVR | 7 |
| 2620 | ANLKR | 6 |
| 119 | GNLKR | 6 |
| 5326 | HILNR | 6 |
| 5327 | MTLMR | 6 |
| 2770 | AALVR | 5 |
| 5107 | AMLQR | 5 |
| 2609 | GNLQR | 5 |
| 2940 | NTLNR | 5 |
| 3027 | NTLVR | 5 |
| 3196 | QTLTR | 5 |
| 5328 | RTLKR | 5 |
| 2666 | SALTR | 5 |
| 2699 | SVLKR | 5 |
| 5104 | AMLTR | 4 |
| 2621 | ANLNR | 4 |
| 2494 | ANLVR | 4 |
| 5158 | APLRR | 4 |
| 3025 | ATLGR | 4 |
| 5329 | ATVRR | 4 |
| 2530 | DTLRR | 4 |
| 3160 | GILRR | 4 |
| 5122 | GMLNR | 4 |
| 3033 | GTLLR | 4 |
| 2707 | GTLQR | 4 |
| 5330 | GVLSR | 4 |
| 5331 | HRLKI | 4 |
| 2830 | HTLVR | 4 |
| 5332 | KTLIR | 4 |
| 5238 | KTLRR | 4 |
| 5087 | NNLKR | 4 |
| 2756 | NSLRR | 4 |
| 2939 | NTLIR | 4 |
| 2677 | SMLTR | 4 |

TABLE 24-continued

ZF4 selection on G:T change at nt 11 of core motif in CBS. Sequences reflect position 2 to 6.

| SEQ ID NO: | Sequence | Read # |
|---|---|---|
| 2524 | SNLAR | 4 |
| 2963 | SNLQR | 4 |
| 2550 | STLAR | 4 |
| 5333 | TILAR | 4 |
| 2766 | TSLKR | 4 |
| 2857 | TTLAR | 4 |
| 2618 | TTLMR | 4 |
| 3117 | AILRR | 3 |
| 5089 | ANLMR | 3 |
| 3090 | ASLAR | 3 |
| 5334 | ASLHR | 3 |
| 5335 | ATLNK | 3 |
| 5336 | ATLRG | 3 |
| 2583 | EALRR | 3 |
| 3049 | GILKR | 3 |
| 5123 | GMLTR | 3 |
| 2706 | GNLNR | 3 |
| 4375 | GPLPV | 3 |
| 5337 | GPLVR | 3 |
| 3245 | GSLSR | 3 |
| 72 | HMLTR | 3 |
| 2827 | HSLRR | 3 |
| 5338 | HVLNR | 3 |
| 5339 | NSLKR | 3 |
| 5340 | NTLMR | 3 |
| 5341 | NVLRR | 3 |
| 2950 | QTLQR | 3 |
| 5342 | RRLNR | 3 |
| 2956 | SALNR | 3 |
| 3292 | SALQR | 3 |
| 2733 | SVLTR | 3 |
| 1986 | AGLKR | 2 |
| 2475 | AGLRR | 2 |
| 1988 | AGLVR | 2 |
| 5150 | AMLHR | 2 |

TABLE 24-continued

ZF4 selection on G:T change at nt 11 of core motif in CBS. Sequences reflect position 2 to 6.

| SEQ ID NO: | Sequence | Read # |
|---|---|---|
| 5151 | AMLIR | 2 |
| 5343 | ARLKI | 2 |
| 3251 | ASLNR | 2 |
| 3244 | ASLSR | 2 |
| 5344 | ATFRR | 2 |
| 5345 | ATLNW | 2 |
| 5346 | ATLRW | 2 |
| 2634 | ESLRR | 2 |
| 3151 | ETLVR | 2 |
| 2778 | GALNR | 2 |
| 2815 | GALQR | 2 |
| 5124 | GMLVR | 2 |
| 2517 | GNLLR | 2 |
| 3230 | HALTR | 2 |
| 5141 | HMLNR | 2 |
| 2558 | HNLRR | 2 |
| 2586 | HTLMR | 2 |
| 2613 | HTLQR | 2 |
| 5347 | IALAG | 2 |
| 5348 | MSLRR | 2 |
| 5349 | MTLLR | 2 |
| 5350 | MTLVR | 2 |
| 3407 | NGRSPV... | 2 |
| 2664 | NMLKR | 2 |
| 2712 | NMLRR | 2 |
| 3191 | PTLRR | 2 |
| 5351 | QRLSV | 2 |
| 4424 | RPLVG | 2 |
| 5352 | RRIDR | 2 |
| 5353 | RRLDS | 2 |
| 5354 | RRVDR | 2 |
| 5355 | RSLIR | 2 |
| 5356 | RTLIR | 2 |
| 5357 | SDLTV | 2 |

TABLE 24-continued

ZF4 selection on G:T change at nt 11 of core motif in CBS. Sequences reflect position 2 to 6.

| SEQ ID NO: | Sequence | Read # |
|---|---|---|
| 2962 | SMLHR | 2 |
| 5358 | SRLKI | 2 |
| 2564 | SSLVR | 2 |
| 5359 | STVRR | 2 |
| 2651 | TTLTR | 2 |
| 2767 | TTLVR | 2 |
| 57 | TVLKR | 2 |
| 2546 | AALAR | 1 |
| 2864 | AALLR | 1 |
| 5360 | AALNS | 1 |
| 3367 | AALRK | 1 |
| 3410 | AALRL | 1 |
| 5147 | AALRS | 1 |
| 5361 | AAVRR | 1 |
| 5259 | AKLQR | 1 |
| 3510 | AKLRR | 1 |
| 3062 | ALLKR | 1 |
| 5149 | AMLAR | 1 |
| 5132 | AMLNR | 1 |
| 5218 | AMLVR | 1 |
| 5094 | ANLHR | 1 |
| 5092 | ANLQR | 1 |
| 5091 | ANLTR | 1 |
|  | AP*C... | 1 |
| 5362 | APLHR | 1 |
| 5363 | APLKR | 1 |
| 5364 | APLMR | 1 |
| 5365 | APLVR | 1 |
| 5366 | APYP... | 1 |
| 5271 | ARLRR | 1 |
| 2874 | ARLTR | 1 |
| 5367 | ARLVG | 1 |
| 5368 | ASFRR | 1 |
| 5369 | ASLER | 1 |
| 3250 | ASLMR | 1 |
|  | AT*G... | 1 |
| 5370 | ATFKR | 1 |
| 5371 | ATFRT | 1 |
| 5372 | ATFTR | 1 |
| 5373 | ATIRR | 1 |
| 5374 | ATLES | 1 |
| 5375 | ATLFR | 1 |
| 5376 | ATLHW | 1 |
| 5377 | ATLIS | 1 |
| 5378 | ATLNH | 1 |
| 5379 | ATLNS | 1 |
| 5380 | ATLQG | 1 |
| 5381 | ATLQW | 1 |
| 5382 | ATLRI | 1 |
| 5383 | ATLRP | 1 |
| 5384 | ATLWR | 1 |
| 5385 | ATSVR | 1 |
| 5386 | ATVAR | 1 |
| 5387 | AVLGR | 1 |
| 5388 | AVLLR | 1 |
| 5389 | AVLNR | 1 |
| 3121 | AVLTR | 1 |
| 3991 | DKLRR | 1 |
| 2640 | DMLKR | 1 |
| 5390 | DRLRA | 1 |
| 2656 | DTLNR | 1 |
| 5391 | EPLVM | 1 |
| 3038 | ETLAR | 1 |
| 3043 | ETLQR | 1 |
| 2592 | GALTR | 1 |
| 2816 | GDLRR | 1 |
| 2913 | GMLAR | 1 |
| 139 | GNLMR | 1 |
| 5392 | GPFKR | 1 |
| 5393 | GPLGL | 1 |

TABLE 24-continued

ZF4 selection on G:T change at nt 11 of core motif in CBS. Sequences reflect position 2 to 6.

| SEQ ID NO: | Sequence | Read # |
|---|---|---|
| 5394 | GPLKR | 1 |
| 5395 | GSLGA | 1 |
| 2781 | GSLQR | 1 |
| 2660 | GSLTR | 1 |
| 5396 | GTFRR | 1 |
| 3014 | GTLDR | 1 |
| 2917 | GTLER | 1 |
| 2918 | GTLGR | 1 |
| 5397 | GTLMW | 1 |
| 5398 | GTLRK | 1 |
| 2562 | GTLTR | 1 |
| 386 | GTLVS | 1 |
| 5399 | GTSNR | 1 |
| 5400 | GTSRR | 1 |
| 5401 | GVLRK | 1 |
| 5402 | GVVRR | 1 |
| 2749 | HALMR | 1 |
| 3246 | HALQR | 1 |
| 3039 | HILKR | 1 |
| 5403 | HILQR | 1 |
| 2578 | HTLAR | 1 |
| 2689 | HTLLR | 1 |
| 2828 | HTLNR | 1 |
| 3180 | HTLRG | 1 |
| 3181 | HTLSR | 1 |
| 3099 | HVLHR | 1 |
| 5404 | KTLLR | 1 |
| 5405 | KTLVR | 1 |
| 5406 | MALRM | 1 |
| 5407 | MPLAR | 1 |
| 4452 | MPLNR | 1 |
| 5408 | MPLVR | 1 |
|  | MRS | 1 |
| 2833 | MTLKR | 1 |
| 4923 | NRLRI | 1 |

TABLE 24-continued

ZF4 selection on G:T change at nt 11 of core motif in CBS. Sequences reflect position 2 to 6.

| SEQ ID NO: | Sequence | Read # |
|---|---|---|
| 2788 | NTLAR | 1 |
| 2837 | NTLHR | 1 |
| 3015 | NTLLR | 1 |
| 2941 | NTLQR | 1 |
| 5409 | NTLRW | 1 |
| 3006 | NTLTR | 1 |
| 5410 | NTLVS | 1 |
| 5411 | NTVRR | 1 |
| 2942 | NVLKR | 1 |
| 5412 | PPLKR | 1 |
| 5413 | PSLKR | 1 |
| 5414 | PTFHR | 1 |
| 5415 | QKLA... | 1 |
| 2574 | QMLKR | 1 |
| 2692 | QSLKR | 1 |
| 3195 | QTLHR | 1 |
| 5416 | QTLIR | 1 |
| 5417 | QTLRQ | 1 |
| 3248 | QTLVR | 1 |
|  | RN*P... | 1 |
| 5418 | RRLAG | 1 |
| 5419 | RRLAR | 1 |
| 5420 | RRLDG | 1 |
| 5421 | RRLHR | 1 |
| 5422 | RRLVR | 1 |
| 5423 | RRSDR | 1 |
| 5424 | RRVEK | 1 |
| 5425 | RTLER | 1 |
| 5426 | RTLNR | 1 |
| 5427 | RTLRG | 1 |
| 5428 | SAVKR | 1 |
| 2559 | SGLKR | 1 |
| 5201 | SKLTR | 1 |
| 2647 | SMLIR | 1 |
| 5145 | SMLNR | 1 |

TABLE 24-continued

ZF4 selection on G:T change at nt 11 of core motif in CBS. Sequences reflect position 2 to 6.

| SEQ ID NO: | Sequence | Read # |
|---|---|---|
| 5304 | SMSRR | 1 |
| 5088 | SNLIR | 1 |
| 5429 | SPLRR | 1 |
| 5430 | SRLRI | 1 |
| 5431 | STLCR | 1 |
| 2848 | STLER | 1 |
| 5432 | STLKS | 1 |
| 5433 | STLRI | 1 |
| 5434 | STSRR | 1 |
| 5435 | SVLRK | 1 |
| 5436 | TALIR | 1 |
| 5437 | TALMR | 1 |
| 2764 | TALTR | 1 |
| 5146 | TMLQR | 1 |
| 5438 | TMLRG | 1 |
| 5131 | TNLIR | 1 |
| 2595 | TNLKR | 1 |
| 5439 | TPIMM | 1 |
| 5215 | TPTRS | 1 |
| 1883 | TRLRV | 1 |
| 5440 | TRSP... | 1 |
| 2858 | TTLGR | 1 |
| 2859 | TTLIR | 1 |
| 5441 | TTLRS | 1 |
| 5442 | TVLNR | 1 |
| 3308 | VSLRR | 1 |
| 2995 | VTLKR | 1 |
| 5443 | VTLQR | 1 |
| 5444 | VVLGN | 1 |
| 5445 | WRLDR | 1 |
| 5446 | WTLRR | 1 |

TABLE 25

ZF3 selection on G:A change at nt 13 of core motif in CBS. Sequences reflect position 2 to 6.

| SEQ ID NO: | Sequence | Read # |
|---|---|---|
| 81 | GQLTV | 1094 |
| 5447 | GQLVV | 906 |
| 78 | GELVV | 766 |
| 5448 | AELIV | 643 |
| 5449 | TELIV | 552 |
| 5450 | QELLV | 528 |
| 5451 | GELIV | 525 |
| 5452 | GELTV | 505 |
| 80 | GQLIV | 476 |
| 5453 | QELLT | 457 |
| 5454 | SELIV | 416 |
| 5455 | GQLLV | 372 |
| 5456 | SGLIV | 372 |
| 5457 | GQLII | 361 |
| 5458 | AELLV | 311 |
| 5459 | VELLI | 277 |
| 5460 | AELVV | 271 |
| 5461 | AQLIV | 267 |
| 76 | SQLIV | 265 |
| 82 | TELII | 251 |
| 83 | QGLLV | 247 |
| 5462 | SQLII | 243 |
| 79 | QQLLI | 224 |
| 5463 | AGLIV | 221 |
| 5464 | QELVV | 209 |
| 5465 | GELLV | 206 |
| 86 | GELLT | 202 |
| 5466 | SQLLV | 199 |
| 5467 | GELVI | 194 |
| 75 | QQLIV | 179 |
| 5468 | QELII | 177 |
| 5469 | TQLIV | 176 |
| 5470 | VELII | 172 |
| 5471 | VELLV | 160 |
| 5472 | GELLI | 151 |

TABLE 25-continued

ZF3 selection on G:A change at nt 13 of core motif in CBS. Sequences reflect position 2 to 6.

| SEQ ID NO: | Sequence | Read # |
|---|---|---|
| 85 | GQLLT | 150 |
| 5473 | NELLI | 149 |
| 5474 | GQLLI | 148 |
| 5475 | SQLLI | 140 |
| 5476 | AQLLV | 136 |
| 5477 | GQLIT | 132 |
| 5478 | GQLTI | 129 |
| 5479 | TELIT | 122 |
| 5480 | TELLI | 118 |
| 5481 | TELLV | 116 |
| 5482 | QELLI | 112 |
| 5483 | AQLVV | 106 |
| 5484 | GSLLV | 104 |
| 5485 | AQLLI | 102 |
| 5486 | HPPEE | 100 |
| 5487 | SQLVV | 100 |
| 77 | QQLLV | 98 |
| 5488 | QELIV | 95 |
| 5489 | SELII | 91 |
| 5490 | AQLII | 90 |
| 5491 | QQLVV | 90 |
| 5492 | TGLLV | 88 |
| 5493 | NQLII | 88 |
| 5494 | GQLVI | 81 |
| 5495 | AGLLV | 80 |
| 5496 | NQLLV | 73 |
| 5497 | QELGV | 69 |
| 5498 | GALVV | 68 |
| 5499 | SQLTV | 67 |
| 5500 | GELTT | 67 |
| 5501 | GELII | 65 |
| 3710 | SGLLV | 63 |
| 5502 | AELII | 60 |
| 5503 | TQLII | 59 |
| 5504 | QQLII | 59 |
| 5505 | AQLIT | 58 |
| 5506 | SQLIT | 58 |
| 5507 | SSLIV | 57 |
| 5508 | SELTV | 57 |
| 5509 | NELLV | 57 |
| 5510 | TQLLV | 56 |
| 5511 | QGLIV | 55 |
| 5512 | QELVI | 55 |
| 5513 | NELIV | 55 |
| 5514 | TELLT | 53 |

TABLE 26

ZF3 selection on G:T change at nt 13 of core motif in CBS. Sequences reflect position 2 to 6.

| SEQ ID NO: | Sequence | Read # |
|---|---|---|
| 79 | QQLLI | 1145 |
| 5452 | GELTV | 1108 |
| 81 | GQLTV | 933 |
| 5474 | GQLLI | 748 |
| 5447 | GQLVV | 545 |
| 5457 | GQLII | 518 |
| 80 | GQLIV | 479 |
| 78 | GELVV | 477 |
| 5515 | GELIT | 438 |
| 5466 | SQLLV | 432 |
| 5462 | SQLII | 431 |
| 85 | GQLLT | 404 |
| 5516 | SQLSM | 365 |
| 84 | QQLLT | 349 |
| 75 | QQLIV | 312 |
| 5486 | HPPEE | 308 |

TABLE 26-continued

ZF3 selection on G:T change at nt 13 of core motif in CBS. Sequences reflect position 2 to 6.

| SEQ ID NO: | Sequence | Read # |
|---|---|---|
| 5453 | QELLT | 300 |
| 5475 | SQLLI | 282 |
| 4773 | GKLNA | 281 |
| 5451 | GELIV | 263 |
| 5455 | GQLLV | 225 |
| 76 | SQLIV | 219 |
| 5517 | RALLI | 216 |
| 5518 | ENLLI | 201 |
| 5476 | AQLLV | 174 |
| 5519 | PDLKR | 174 |
| 86 | GELLT | 172 |
| 5505 | AQLIT | 164 |
| 5520 | GQLVT | 138 |
| 5521 | GQLLS | 116 |
| 5450 | QELLV | 112 |
| 5522 | GELNP | 112 |
| 5523 | GQLIQ | 98 |
| 5524 | PTLVG | 98 |
| 5525 | LVLAD | 95 |
| 5526 | EALRA | 94 |
| 5467 | GELVI | 87 |
| 1926 | STLKA | 87 |
| 5494 | GQLVI | 85 |
| 5463 | AGLIV | 82 |
| 5527 | GQLTL | 82 |
| 5528 | NVLGT | 81 |
| 5529 | KGLGP | 79 |
| 5530 | MQLRR | 79 |
| 3026 | GDLQR | 75 |
| 5531 | VLLPN | 71 |
| 5532 | MRLGD | 69 |
| 5533 | GQLAQ | 67 |
| 4074 | NELRG | 67 |
| 5500 | GELTT | 66 |

TABLE 26-continued

ZF3 selection on G:T change at nt 13 of core motif in CBS. Sequences reflect position 2 to 6.

| SEQ ID NO: | Sequence | Read # |
|---|---|---|
| 5534 | GELVT | 64 |
| 333 | STLVV | 63 |
| 5535 | VDLAV | 61 |
| 5536 | AQLTI | 59 |
| 5537 | DALPA | 57 |
| 5538 | SVLQL | 57 |
| 5539 | GPLGN | 56 |
| 5540 | GHLLL | 52 |
| 5541 | DVLDP | 51 |
| 5542 | SSLSI | 50 |
| 5543 | KM LAD | 50 |

TABLE 27

ZF3 selection on G:C change at nt 13 of core motif in CBS. Sequences reflect position 2 to 6.

| SEQ ID NO: | Sequence | # Reads |
|---|---|---|
| 173 | RKHD | 4641 |
| 175 | RKAD | 1938 |
| 174 | RRSD | 1299 |
| 681 | RRHD | 868 |
| 682 | RKTD | 182 |
| 683 | NVSM | 146 |
| 684 | RQSD | 76 |
| 685 | RKND | 69 |
| 686 | SENV | 69 |
| 687 | VDHR | 60 |
| 688 | AQIV | 58 |
| 689 | KTPH | 56 |
| 690 | PKIV | 51 |
| 691 | GAEP | 42 |
| 692 | MLVE | 40 |
| 693 | VVGN | 40 |

TABLE 27-continued

ZF3 selection on G:C change at nt 13 of core motif in CBS. Sequences reflect position 2 to 6.

| S

TABLE 27-continued

ZF3
selection on G:C
change at nt 13 of
core motif in CBS.
Sequences reflect
position 2 to 6.

| SEQ ID NO: | Sequence | # Reads |
|---|---|---|
| 762 | SSHD | 1 |
| 763 | TTHV | 1 |
| 764 | VHHV | 1 |
| 765 | WKAD | 1 |
| 766 | WKHD | 1 |

REFERENCES

1. Ong, Chin-Tong & Corces, V. P., *Nat Rev Genet.* 2014 April; 15(4):234-46.
2. Phillips, J. & Corces, V. P., *Cell.* 2009 Jun. 26; 137(7): 1194-1211.
3. Ali, T. et al., *Curr Opin Genet Dev.* 2016 April; 37:17-26.
4. Nora, E. P. et al., *Nature.* 2012 Apr. 11; 485(7398):381-5.
5. Rao, S. S. et al., *Cell.* 2014 Dec. 18; 159(7): 1665-1680.
6. Phillip, J., et al., *Cell.* 2013 Jun. 6; 153(6): 1281-1295.
7. Shukla, S., et al., *Nature.* 2011 Nov. 3; 479(7371):74-9.
8. Hilmi, K., et al. *Sci Adv.* 2017 May 24; 3(5):e1601898.
9. Han, D., et al. *Sci Rep.* 2017 Mar. 6; 7:43530.
10. Rhee, S., & Pugh, F. B., *Cell.* 2011 Dec. 9; 147(6):1408-19.
11. Nakahashi, H., et al., *Cell Rep.* 2013 May 30; 3(5):1678-1689.
12. Hashimoto, et al., *Mol Cell.* 2017 Jun. 1; 66(5):711-720.e3.
13. Guo, A. et al., *Nat Commun.* 2018 Apr. 18; 9(1):1520.
14. Schuijers, J. et al., *Cell Reports* (2018). *Cell Rep.* 2018 Apr. 10; 23(2):349-360.
15. Kang, J. Y. et al., *Oncogene.* 2015 Nov. 5; 34(45):5677-84.
16. Wright, D., et al. *Nat Protoc.* 2006; 1(3):1637-52.
17. Sander, J., et al. *Nat Methods.* 2011 January; 8(1):67-9.
18. Maeder, M., et al. *Mol Cell.* 2008 Jul. 25; 31(2):294-301.
19. Joung J. K. et al., *Proc Natl Acad Sci USA.* 2000 Jun. 20; 97(13):7382-7.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (5575 sequences)

SEQ ID NO: 1 - protein, 7 aa, Homo sapiens
TSGELVR

SEQ ID NO: 2 - protein, 7 aa, Homo sapiens
EVSKLKR

SEQ ID NO: 3 - protein, 7 aa, Homo sapiens
DTYKLKR

SEQ ID NO: 4 - protein, 7 aa, Homo sapiens
QSGTMKM

SEQ ID NO: 5 - protein, 7 aa, Homo sapiens
RKSDLGV

SEQ ID NO: 6 - DNA, 15 bp, Artificial Sequence
  Description of Artificial Sequence: Synthetic oligonucleotide
ccagcagggggcgct

SEQ ID NO: 7 - protein, 25 aa, Artificial Sequence
  Description of Artificial Sequence: Synthetic peptide
  MOD_RES (2)..(5): Any amino acid
  MISC_FEATURE (2)..(5): This region may encompass 2-4 residues
  MOD_RES (7)..(18): Any amino acid
  MOD_RES (20)..(24): Any amino acid
  MISC_FEATURE (20)..(24): This region may encompass 3-5 residues
CXXXXCXXXXXXXXXXXXHXXXXXH

SEQ ID NO: 8 - protein, 5 aa, Artificial Sequence
  Description of Artificial Sequence: Synthetic peptide
DHLQT

SEQ ID NO: 9 - protein, 5 aa, Artificial Sequence
  Description of Artificial Sequence: Synthetic peptide
EHLNV

SEQ ID NO: 10 - protein, 5 aa, Artificial Sequence
  Description of Artificial Sequence: Synthetic peptide
AHLQV

SEQ ID NO: 11 - protein, 5 aa, Artificial Sequence
  Description of Artificial Sequence: Synthetic peptide
EHLRE

SEQ ID NO: 12 - protein, 5 aa, Artificial Sequence
  Description of Artificial Sequence: Synthetic peptide
DHLQV

SEQ ID NO: 13 - protein, 5 aa, Artificial Sequence
  Description of Artificial Sequence: Synthetic peptide
EHLKV

SEQ ID NO: 14 - protein, 5 aa, Artificial Sequence
  Description of Artificial Sequence: Synthetic peptide
DHLQV

SEQ ID NO: 15 - protein, 5 aa, Artificial Sequence
  Description of Artificial Sequence: Synthetic peptide
EHLVV

SEQ ID NO: 16 - protein, 5 aa, Artificial Sequence
  Description of Artificial Sequence: Synthetic peptide
DHLRT

SEQ ID NO: 17 - protein, 5 aa, Artificial Sequence
  Description of Artificial Sequence: Synthetic peptide
DHLAT

SEQ ID NO: 18 - protein, 5 aa, Artificial Sequence
  Description of Artificial Sequence: Synthetic peptide
DHLQT

SEQ ID NO: 19 - protein, 5 aa, Artificial Sequence
  Description of Artificial Sequence: Synthetic peptide
DHLQT

SEQ ID NO: 20 - protein, 5 aa, Artificial Sequence
  Description of Artificial Sequence: Synthetic peptide
EHLNV

SEQ ID NO: 21 - protein, 5 aa, Artificial Sequence
  Description of Artificial Sequence: Synthetic peptide
AHLQV

SEQ ID NO: 22 - protein, 5 aa, Artificial Sequence
  Description of Artificial Sequence: Synthetic peptide
EHLRE

SEQ ID NO: 23 - protein, 5 aa, Artificial Sequence
  Description of Artificial Sequence: Synthetic peptide
DHLQV

SEQ ID NO: 24 - protein, 5 aa, Artificial Sequence
  Description of Artificial Sequence: Synthetic peptide
EHLKV

SEQ ID NO: 25 - protein, 5 aa, Artificial Sequence
  Description of Artificial Sequence: Synthetic peptide
DHLQV

SEQ ID NO: 26 - protein, 5 aa, Artificial Sequence
  Description of Artificial Sequence: Synthetic peptide
EHLVV

SEQ ID NO: 27 - protein, 5 aa, Artificial Sequence
  Description of Artificial Sequence: Synthetic peptide
DHLRT

SEQ ID NO: 28 - protein, 5 aa, Artificial Sequence
  Description of Artificial Sequence: Synthetic peptide
DHLAT

SEQ ID NO: 29 - protein, 5 aa, Artificial Sequence
  Description of Artificial Sequence: Synthetic peptide
DHLQT

SEQ ID NO: 30 - protein, 5 aa, Artificial Sequence
  Description of Artificial Sequence: Synthetic peptide
NAMKR

SEQ ID NO: 31 - protein, 5 aa, Artificial Sequence
  Description of Artificial Sequence: Synthetic peptide
EHMGR

SEQ ID NO: 32 - protein, 5 aa, Artificial Sequence
  Description of Artificial Sequence: Synthetic peptide
DHMNR

SEQ ID NO: 33 - protein, 5 aa, Artificial Sequence
  Description of Artificial Sequence: Synthetic peptide
THMKR

SEQ ID NO: 34 - protein, 5 aa, Artificial Sequence
  Description of Artificial Sequence: Synthetic peptide
EHMRR

SEQ ID NO: 35 - protein, 5 aa, Artificial Sequence
  Description of Artificial Sequence: Synthetic peptide
THMNR

SEQ ID NO: 36 - protein, 4 aa, Artificial Sequence
  Description of Artificial Sequence: Synthetic peptide
MNES

SEQ ID NO: 37 - protein, 4 aa, Artificial Sequence
  Description of Artificial Sequence: Synthetic peptide
HRES

SEQ ID NO: 38 - protein, 4 aa, Artificial Sequence
  Description of Artificial Sequence: Synthetic peptide
RPDT

SEQ ID NO: 39 - protein, 4 aa, Artificial Sequence
  Description of Artificial Sequence: Synthetic peptide
RTDI

SEQ ID NO: 40 - protein, 4 aa, Artificial Sequence
  Description of Artificial Sequence: Synthetic peptide
RHDT

SEQ ID NO: 41 - protein, 5 aa, Artificial Sequence
  Description of Artificial Sequence: Synthetic peptide
HGLKV

SEQ ID NO: 42 - protein, 5 aa, Artificial Sequence
  Description of Artificial Sequence: Synthetic peptide
HRLKE

SEQ ID NO: 43 - protein, 5 aa, Artificial Sequence
  Description of Artificial Sequence: Synthetic peptide
HALKV

SEQ ID NO: 44 - protein, 5 aa, Artificial Sequence
  Description of Artificial Sequence: Synthetic peptide
SRLKE

SEQ ID NO: 45 - protein, 5 aa, Artificial Sequence
  Description of Artificial Sequence: Synthetic peptide
DGLRV

SEQ ID NO: 46 - protein, 5 aa, Artificial Sequence
  Description of Artificial Sequence: Synthetic peptide
HTLKV

SEQ ID NO: 47 - protein, 5 aa, Artificial Sequence
  Description of Artificial Sequence: Synthetic peptide
NRLKE

SEQ ID NO: 48 - protein, 5 aa, Artificial Sequence
  Description of Artificial Sequence: Synthetic peptide
ATLKR

SEQ ID NO: 49 - protein, 5 aa, Artificial Sequence
  Description of Artificial Sequence: Synthetic peptide
QALRR

SEQ ID NO: 50 - protein, 5 aa, Artificial Sequence
  Description of Artificial Sequence: Synthetic peptide
GGLVR

SEQ ID NO: 51 - protein, 5 aa, Artificial Sequence
  Description of Artificial Sequence: Synthetic peptide
HGLIR

SEQ ID NO: 52 - protein, 5 aa, Artificial Sequence
  Description of Artificial Sequence: Synthetic peptide
ANLSR

SEQ ID NO: 53 - protein, 5 aa, Artificial Sequence
  Description of Artificial Sequence: Synthetic peptide
TGLTR

SEQ ID NO: 54 - protein, 5 aa, Artificial Sequence
  Description of Artificial Sequence: Synthetic peptide
HGLVR

SEQ ID NO: 55 - protein, 5 aa, Artificial Sequence
  Description of Artificial Sequence: Synthetic peptide
GGLTR

SEQ ID NO: 56 - protein, 5 aa, Artificial Sequence
  Description of Artificial Sequence: Synthetic peptide
HTLRR

SEQ ID NO: 57 - protein, 5 aa, Artificial Sequence
  Description of Artificial Sequence: Synthetic peptide
TVLKR

SEQ ID NO: 58 - protein, 5 aa, Artificial Sequence
  Description of Artificial Sequence: Synthetic peptide
ADLKR

SEQ ID NO: 59 - protein, 5 aa, Artificial Sequence
  Description of Artificial Sequence: Synthetic peptide
HGLRR

SEQ ID NO: 60 - protein, 5 aa, Artificial Sequence
  Description of Artificial Sequence: Synthetic peptide
AHLRK

SEQ ID NO: 61 - protein, 5 aa, Artificial Sequence
  Description of Artificial Sequence: Synthetic peptide
AKLRV

SEQ ID NO: 62 - protein, 5 aa, Artificial Sequence
  Description of Artificial Sequence: Synthetic peptide
GGLGL

SEQ ID NO: 63 - protein, 5 aa, Artificial Sequence
  Description of Artificial Sequence: Synthetic peptide
AKLRI

SEQ ID NO: 64 - protein, 5 aa, Artificial Sequence
  Description of Artificial Sequence: Synthetic peptide
TKLKV

SEQ ID NO: 65 - protein, 5 aa, Artificial Sequence
  Description of Artificial Sequence: Synthetic peptide
SKLRV

SEQ ID NO: 66 - protein, 5 aa, Artificial Sequence
  Description of Artificial Sequence: Synthetic peptide
ATLRR

SEQ ID NO: 67 - protein, 5 aa, Artificial Sequence
  Description of Artificial Sequence: Synthetic peptide
RRLDR

SEQ ID NO: 68 - protein, 5 aa, Artificial Sequence
  Description of Artificial Sequence: Synthetic peptide
TNLRR

SEQ ID NO: 69 - protein, 5 aa, Artificial Sequence
  Description of Artificial Sequence: Synthetic peptide
ANLRR

SEQ ID NO: 70 - protein, 5 aa, Artificial Sequence
  Description of Artificial Sequence: Synthetic peptide
GNLTR

SEQ ID NO: 71 - protein, 5 aa, Artificial Sequence
  Description of Artificial Sequence: Synthetic peptide
AMLKR

SEQ ID NO: 72 - protein, 5 aa, Artificial Sequence
  Description of Artificial Sequence: Synthetic peptide
HMLTR

SEQ ID NO: 73 - protein, 5 aa, Artificial Sequence
  Description of Artificial Sequence: Synthetic peptide
AMLRR

SEQ ID NO: 74 - protein, 5 aa, Artificial Sequence
  Description of Artificial Sequence: Synthetic peptide
TMLRR

SEQ ID NO: 75 - protein, 5 aa, Artificial Sequence
  Description of Artificial Sequence: Synthetic peptide
QQLIV

SEQ ID NO: 76 - protein, 5 aa, Artificial Sequence
  Description of Artificial Sequence: Synthetic peptide
SQLIV

SEQ ID NO: 77 - protein, 5 aa, Artificial Sequence
  Description of Artificial Sequence: Synthetic peptide
QQLLV

SEQ ID NO: 78 - protein, 5 aa, Artificial Sequence
  Description of Artificial Sequence: Synthetic peptide
GELVV

SEQ ID NO: 79 - protein, 5 aa, Artificial Sequence
  Description of Artificial Sequence: Synthetic peptide
QQLLI

SEQ ID NO: 80 - protein, 5 aa, Artificial Sequence
  Description of Artificial Sequence: Synthetic peptide
GQLIV

SEQ ID NO: 81 - protein, 5 aa, Artificial Sequence
  Description of Artificial Sequence: Synthetic peptide
GQLTV

SEQ ID NO: 82 - protein, 5 aa, Artificial Sequence
  Description of Artificial Sequence: Synthetic peptide
TELII

SEQ ID NO: 83 - protein, 5 aa, Artificial Sequence
  Description of Artificial Sequence: Synthetic peptide
QGLLV

SEQ ID NO: 84 - protein, 5 aa, Artificial Sequence
  Description of Artificial Sequence: Synthetic peptide
QQLLT

SEQ ID NO: 85 - protein, 5 aa, Artificial Sequence
  Description of Artificial Sequence: Synthetic peptide
GQLLT

SEQ ID NO: 86 - protein, 5 aa, Artificial Sequence
  Description of Artificial Sequence: Synthetic peptide
GELLT

SEQ ID NO: 87 - protein, 5 aa, Artificial Sequence
  Description of Artificial Sequence: Synthetic peptide
QQLLI

SEQ ID NO: 88 - protein, 5 aa, Artificial Sequence
  Description of Artificial Sequence: Synthetic peptide
AKLKK

SEQ ID NO: 89 - protein, 5 aa, Artificial Sequence
  Description of Artificial Sequence: Synthetic peptide
AKLRK

SEQ ID NO: 90 - protein, 5 aa, Artificial Sequence
  Description of Artificial Sequence: Synthetic peptide
AHLRV

SEQ ID NO: 91 - protein, 5 aa, Artificial Sequence
  Description of Artificial Sequence: Synthetic peptide
AKLRV

SEQ ID NO: 92 - protein, 5 aa, Artificial Sequence
  Description of Artificial Sequence: Synthetic peptide
SKLRL

SEQ ID NO: 93 - protein, 5 aa, Artificial Sequence
  Description of Artificial Sequence: Synthetic peptide
ERLRV

SEQ ID NO: 94 - protein, 5 aa, Artificial Sequence
  Description of Artificial Sequence: Synthetic peptide
NRLKV

SEQ ID NO: 95 - protein, 5 aa, Artificial Sequence
  Description of Artificial Sequence: Synthetic peptide
SRLKE

SEQ ID NO: 96 - protein, 5 aa, Artificial Sequence
  Description of Artificial Sequence: Synthetic peptide
NRLKV

SEQ ID NO: 97 - protein, 4 aa, Artificial Sequence
  Description of Artificial Sequence: Synthetic peptide
RPDT

SEQ ID NO: 98 - protein, 4 aa, Artificial Sequence
  Description of Artificial Sequence: Synthetic peptide
RTET

SEQ ID NO: 99 - protein, 4 aa, Artificial Sequence
  Description of Artificial Sequence: Synthetic peptide
RADV

SEQ ID NO: 100 - protein, 5 aa, Artificial Sequence
  Description of Artificial Sequence: Synthetic peptide
DNLLA

SEQ ID NO: 101 - protein, 5 aa, Artificial Sequence
  Description of Artificial Sequence: Synthetic peptide
SNLLV

SEQ ID NO: 102 - protein, 5 aa, Artificial Sequence
  Description of Artificial Sequence: Synthetic peptide
DNLMA

SEQ ID NO: 103 - protein, 5 aa, Artificial Sequence
  Description of Artificial Sequence: Synthetic peptide
DNLRV

SEQ ID NO: 104 - protein, 5 aa, Artificial Sequence
  Description of Artificial Sequence: Synthetic peptide
GHLKK

SEQ ID NO: 105 - protein, 5 aa, Artificial Sequence
  Description of Artificial Sequence: Synthetic peptide
AHLRK

SEQ ID NO: 106 - protein, 5 aa, Artificial Sequence
  Description of Artificial Sequence: Synthetic peptide
GKLRI

SEQ ID NO: 107 - protein, 5 aa, Artificial Sequence
  Description of Artificial Sequence: Synthetic peptide
SRLKE

SEQ ID NO: 108 - protein, 5 aa, Artificial Sequence
  Description of Artificial Sequence: Synthetic peptide
DALRR

SEQ ID NO: 109 - protein, 5 aa, Artificial Sequence
  Description of Artificial Sequence: Synthetic peptide
DGLKR

SEQ ID NO: 110 - protein, 5 aa, Artificial Sequence
  Description of Artificial Sequence: Synthetic peptide
TRLRE

SEQ ID NO: 111 - protein, 4 aa, Artificial Sequence
  Description of Artificial Sequence: Synthetic peptide
RPDT

SEQ ID NO: 112 - protein, 4 aa, Artificial Sequence
  Description of Artificial Sequence: Synthetic peptide
RTEN

SEQ ID NO: 113 - protein, 5 aa, Artificial Sequence
  Description of Artificial Sequence: Synthetic peptide
EHLKV

SEQ ID NO: 114 - protein, 5 aa, Artificial Sequence
  Description of Artificial Sequence: Synthetic peptide
DHLLA

SEQ ID NO: 115 - protein, 5 aa, Artificial Sequence
  Description of Artificial Sequence: Synthetic peptide
HHLDV

SEQ ID NO: 116 - protein, 5 aa, Artificial Sequence
  Description of Artificial Sequence: Synthetic peptide
SNLRR

SEQ ID NO: 117 - protein, 5 aa, Artificial Sequence
  Description of Artificial Sequence: Synthetic peptide
GNLVR

SEQ ID NO: 118 - protein, 5 aa, Artificial Sequence
  Description of Artificial Sequence: Synthetic peptide
GNLRR

SEQ ID NO: 119 - protein, 5 aa, Artificial Sequence
  Description of Artificial Sequence: Synthetic peptide
GNLKR

SEQ ID NO: 120 - protein, 5 aa, Artificial Sequence
  Description of Artificial Sequence: Synthetic peptide
ANLRR

SEQ ID NO: 121 - protein, 5 aa, Artificial Sequence
  Description of Artificial Sequence: Synthetic peptide
NNLRR

SEQ ID NO: 122 - protein, 5 aa, Artificial Sequence
  Description of Artificial Sequence: Synthetic peptide
TNLRR

SEQ ID NO: 123 - protein, 5 aa, Artificial Sequence
  Description of Artificial Sequence: Synthetic peptide
EHMKR

SEQ ID NO: 124 - protein, 5 aa, Artificial Sequence
  Description of Artificial Sequence: Synthetic peptide
EHMRR

SEQ ID NO: 125 - protein, 5 aa, Artificial Sequence
  Description of Artificial Sequence: Synthetic peptide
THMKR

SEQ ID NO: 126 - protein, 5 aa, Artificial Sequence
  Description of Artificial Sequence: Synthetic peptide
EHMNR

SEQ ID NO: 127 - protein, 5 aa, Artificial Sequence
  Description of Artificial Sequence: Synthetic peptide
EHMAR

SEQ ID NO: 128 - protein, 5 aa, Artificial Sequence
  Description of Artificial Sequence: Synthetic peptide
DNLLT

SEQ ID NO: 129 - protein, 5 aa, Artificial Sequence
  Description of Artificial Sequence: Synthetic peptide
DNLLV

SEQ ID NO: 130 - protein, 5 aa, Artificial Sequence
  Description of Artificial Sequence: Synthetic peptide
DNLQT

SEQ ID NO: 131 - protein, 5 aa, Artificial Sequence
  Description of Artificial Sequence: Synthetic peptide
DNLLA

SEQ ID NO: 132 - protein, 5 aa, Artificial Sequence
  Description of Artificial Sequence: Synthetic peptide
DNLAT

SEQ ID NO: 133 - protein, 5 aa, Artificial Sequence
  Description of Artificial Sequence: Synthetic peptide
DNLQA

SEQ ID NO: 134 - protein, 5 aa, Artificial Sequence
  Description of Artificial Sequence: Synthetic peptide
DNLMA

SEQ ID NO: 135 - protein, 5 aa, Artificial Sequence
  Description of Artificial Sequence: Synthetic peptide
DNLMT

SEQ ID NO: 136 - protein, 5 aa, Artificial Sequence
  Description of Artificial Sequence: Synthetic peptide
GNLVR

SEQ ID NO: 137 - protein, 5 aa, Artificial Sequence
  Description of Artificial Sequence: Synthetic peptide
GNLRR

SEQ ID NO: 138 - protein, 5 aa, Artificial Sequence
  Description of Artificial Sequence: Synthetic peptide
GNLAR

SEQ ID NO: 139 - protein, 5 aa, Artificial Sequence
  Description of Artificial Sequence: Synthetic peptide
GNLMR

SEQ ID NO: 140 - protein, 5 aa, Artificial Sequence
  Description of Artificial Sequence: Synthetic peptide
ANLRR

SEQ ID NO: 141 - protein, 5 aa, Artificial Sequence
  Description of Artificial Sequence: Synthetic peptide
SNLRR

SEQ ID NO: 142 - protein, 5 aa, Artificial Sequence
  Description of Artificial Sequence: Synthetic peptide
NNLRR

SEQ ID NO: 143 - protein, 5 aa, Artificial Sequence
  Description of Artificial Sequence: Synthetic peptide
EHMNR

SEQ ID NO: 144 - protein, 5 aa, Artificial Sequence
  Description of Artificial Sequence: Synthetic peptide
EHMKR

SEQ ID NO: 145 - protein, 5 aa, Artificial Sequence
  Description of Artificial Sequence: Synthetic peptide
EHMRR

SEQ ID NO: 146 - protein, 5 aa, Artificial Sequence
  Description of Artificial Sequence: Synthetic peptide
SHMNR

SEQ ID NO: 147 - protein, 5 aa, Artificial Sequence
  Description of Artificial Sequence: Synthetic peptide
SHMRR

SEQ ID NO: 148 - protein, 5 aa, Artificial Sequence
  Description of Artificial Sequence: Synthetic peptide
THMKR

SEQ ID NO: 149 - protein, 5 aa, Artificial Sequence
  Description of Artificial Sequence: Synthetic peptide
DHMNR

SEQ ID NO: 150 - protein, 5 aa, Artificial Sequence
  Description of Artificial Sequence: Synthetic peptide
EHLKV

SEQ ID NO: 151 - protein, 5 aa, Artificial Sequence
  Description of Artificial Sequence: Synthetic peptide
EHLAE

SEQ ID NO: 152 - protein, 5 aa, Artificial Sequence
  Description of Artificial Sequence: Synthetic peptide
STLNE

SEQ ID NO: 153 - protein, 5 aa, Artificial Sequence
  Description of Artificial Sequence: Synthetic peptide
DHLQV

SEQ ID NO: 154 - protein, 5 aa, Artificial Sequence
  Description of Artificial Sequence: Synthetic peptide
EHLNV

SEQ ID NO: 155 - protein, 5 aa, Artificial Sequence
  Description of Artificial Sequence: Synthetic peptide
DHLNT

SEQ ID NO: 156 - protein, 5 aa, Artificial Sequence
  Description of Artificial Sequence: Synthetic peptide
EHLQA

SEQ ID NO: 157 - protein, 5 aa, Artificial Sequence
  Description of Artificial Sequence: Synthetic peptide
HHLMH

SEQ ID NO: 158 - protein, 5 aa, Artificial Sequence
  Description of Artificial Sequence: Synthetic peptide
GHLKK

SEQ ID NO: 159 - protein, 5 aa, Artificial Sequence
  Description of Artificial Sequence: Synthetic peptide
AHLKK

SEQ ID NO: 160 - protein, 5 aa, Artificial Sequence
  Description of Artificial Sequence: Synthetic peptide
TKLRL

SEQ ID NO: 161 - protein, 5 aa, Artificial Sequence
  Description of Artificial Sequence: Synthetic peptide
TKLKL

SEQ ID NO: 162 - protein, 5 aa, Artificial Sequence
  Description of Artificial Sequence: Synthetic peptide
GHLRK

SEQ ID NO: 163 - protein, 5 aa, Artificial Sequence
  Description of Artificial Sequence: Synthetic peptide
THLKK

SEQ ID NO: 164 - protein, 5 aa, Artificial Sequence
  Description of Artificial Sequence: Synthetic peptide
AHLRK

SEQ ID NO: 165 - protein, 5 aa, Artificial Sequence
  Description of Artificial Sequence: Synthetic peptide
TRLKE

SEQ ID NO: 166 - protein, 5 aa, Artificial Sequence
  Description of Artificial Sequence: Synthetic peptide
SRLKE

SEQ ID NO: 167 - protein, 4 aa, Artificial Sequence
  Description of Artificial Sequence: Synthetic peptide
RADN

SEQ ID NO: 168 - protein, 4 aa, Artificial Sequence
  Description of Artificial Sequence: Synthetic peptide
RHDT

SEQ ID NO: 169 - protein, 4 aa, Artificial Sequence
  Description of Artificial Sequence: Synthetic peptide
RRDT

SEQ ID NO: 170 - protein, 4 aa, Artificial Sequence
  Description of Artificial Sequence: Synthetic peptide
RPDT

SEQ ID NO: 171 - protein, 4 aa, Artificial Sequence
  Description of Artificial Sequence: Synthetic peptide
RTSS

SEQ ID NO: 172 - protein, 4 aa, Artificial Sequence
  Description of Artificial Sequence: Synthetic peptide
RNDT

SEQ ID NO: 173 - protein, 4 aa, Artificial Sequence
  Description of Artificial Sequence: Synthetic peptide
RKHD

SEQ ID NO: 174 - protein, 4 aa, Artificial Sequence
  Description of Artificial Sequence: Synthetic peptide
RRSD

SEQ ID NO: 175 - protein, 4 aa, Artificial Sequence
  Description of Artificial Sequence: Synthetic peptide
RKAD

SEQ ID NO: 176 - protein, 4 aa, Artificial Sequence
  Description of Artificial Sequence: Synthetic peptide
IPRI

SEQ ID NO: 177 - protein, 4 aa, Artificial Sequence
  Description of Artificial Sequence: Synthetic peptide
RKDD

SEQ ID NO: 178 - protein, 4 aa, Artificial Sequence
  Description of Artificial Sequence: Synthetic peptide
GIVN

SEQ ID NO: 179 - protein, 4 aa, Artificial Sequence
  Description of Artificial Sequence: Synthetic peptide
ELLN

SEQ ID NO: 180 - protein, 4 aa, Artificial Sequence
  Description of Artificial Sequence: Synthetic peptide
QALL

SEQ ID NO: 181 - protein, 4 aa, Artificial Sequence
  Description of Artificial Sequence: Synthetic peptide
PHRM

SEQ ID NO: 182 - protein, 5 aa, Artificial Sequence
  Description of Artificial Sequence: Synthetic peptide
GNMAR

SEQ ID NO: 183 - protein, 5 aa, Artificial Sequence
  Description of Artificial Sequence: Synthetic peptide
EGMTR

SEQ ID NO: 184 - protein, 5 aa, Artificial Sequence
  Description of Artificial Sequence: Synthetic peptide
SNMVR

SEQ ID NO: 185 - protein, 5 aa, Artificial Sequence
  Description of Artificial Sequence: Synthetic peptide
NAMRG

SEQ ID NO: 186 - protein, 5 aa, Artificial Sequence
  Description of Artificial Sequence: Synthetic peptide
EKLRI

SEQ ID NO: 187 - protein, 5 aa, Artificial Sequence
  Description of Artificial Sequence: Synthetic peptide
GKLVT

SEQ ID NO: 188 - protein, 7 aa, Artificial Sequence
  Description of Artificial Sequence: Synthetic peptide
RPDTMKR

SEQ ID NO: 189 - protein, 7 aa, Artificial Sequence
  Description of Artificial Sequence: Synthetic peptide
RTENMKM

SEQ ID NO: 190 - protein, 727 aa, Homo sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPTKIKKKGVKKTFQCELCSYTCPRRSNLDRHMKSHTDERPHKCHLCGRAFRTVTLLRNHLNTHTGTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPTAIIQVEDQNTGAIENIIVEVKKEPDAEPAEGEEEEAQPAATDAPNGDLTPEMILSMMDR

SEQ ID NO: 191 - DNA, 15 bp, Artificial Sequence
  Description of Artificial Sequence: Synthetic oligonucleotide
  modified_base (1)..(1): a, c, t, g, unknown or other
  modified_base (4)..(4): a, c, t, g, unknown or other
  modified_base (6)..(6): a, c, t, g, unknown or other
  modified_base (9)..(9): a, c, t, g, unknown or other
  modified_base (12)..(15): a, c, t, g, unknown or other
ncdnhngrngdnnnn

SEQ ID NO: 192 - protein, 5 aa, Artificial Sequence
  Description of Artificial Sequence: Synthetic peptide
KDLVV

SEQ ID NO: 193 - protein, 5 aa, Artificial Sequence
  Description of Artificial Sequence: Synthetic peptide
DHLQA

SEQ ID NO: 194 - protein, 5 aa, Artificial Sequence
  Description of Artificial Sequence: Synthetic peptide
DHLLV

SEQ ID NO: 195 - protein, 5 aa, Artificial Sequence
  Description of Artificial Sequence: Synthetic peptide
DHLLT

SEQ ID NO: 196 - protein, 5 aa, Artificial Sequence
  Description of Artificial Sequence: Synthetic peptide
EHLTV

SEQ ID NO: 197 - protein, 5 aa, Artificial Sequence
  Description of Artificial Sequence: Synthetic peptide
STLME

SEQ ID NO: 198 - protein, 5 aa, Artificial Sequence
  Description of Artificial Sequence: Synthetic peptide
DHLKT

SEQ ID NO: 199 - protein, 5 aa, Artificial Sequence
  Description of Artificial Sequence: Synthetic peptide
EHLKE

SEQ ID NO: 200 - protein, 5 aa, Artificial Sequence
  Description of Artificial Sequence: Synthetic peptide
DHLLE

SEQ ID NO: 201 - protein, 5 aa, Artificial Sequence
  Description of Artificial Sequence: Synthetic peptide
EHLRV

SEQ ID NO: 202 - protein, 5 aa, Artificial Sequence
  Description of Artificial Sequence: Synthetic peptide
STLRE

SEQ ID NO: 203 - protein, 5 aa, Artificial Sequence
  Description of Artificial Sequence: Synthetic peptide
DHLMV

SEQ ID NO: 204 - protein, 5 aa, Artificial Sequence
  Description of Artificial Sequence: Synthetic peptide
DHLKV

SEQ ID NO: 205 - protein, 5 aa, Artificial Sequence
  Description of Artificial Sequence: Synthetic peptide
DHLRV

SEQ ID NO: 206 - protein, 5 aa, Artificial Sequence
  Description of Artificial Sequence: Synthetic peptide
DHLNV

SEQ ID NO: 207 - protein, 5 aa, Artificial Sequence
  Description of Artificial Sequence: Synthetic peptide
DHLKE

SEQ ID NO: 208 - protein, 5 aa, Artificial Sequence
  Description of Artificial Sequence: Synthetic peptide
DHLNE

SEQ ID NO: 209 - protein, 5 aa, Artificial Sequence
  Description of Artificial Sequence: Synthetic peptide
STLLE

SEQ ID NO: 210 - protein, 5 aa, Artificial Sequence
  Description of Artificial Sequence: Synthetic peptide
DHLMA

SEQ ID NO: 211 - protein, 5 aa, Artificial Sequence
  Description of Artificial Sequence: Synthetic peptide
KDLTV

SEQ ID NO: 212 - protein, 5 aa, Artificial Sequence
  Description of Artificial Sequence: Synthetic peptide
DHLVT

SEQ ID NO: 213 - protein, 5 aa, Artificial Sequence
  Description of Artificial Sequence: Synthetic peptide
AHLNV

SEQ ID NO: 214 - protein, 5 aa, Artificial Sequence
  Description of Artificial Sequence: Synthetic peptide
AHLTV

SEQ ID NO: 215 - protein, 5 aa, Artificial Sequence
  Description of Artificial Sequence: Synthetic peptide
HTLME

SEQ ID NO: 216 - protein, 5 aa, Artificial Sequence
  Description of Artificial Sequence: Synthetic peptide
DHLRA

SEQ ID NO: 217 - protein, 5 aa, Artificial Sequence
  Description of Artificial Sequence: Synthetic peptide
DHLAV

SEQ ID NO: 218 - protein, 5 aa, Artificial Sequence
  Description of Artificial Sequence: Synthetic peptide
HHLAE

SEQ ID NO: 219 - protein, 5 aa, Artificial Sequence
  Description of Artificial Sequence: Synthetic peptide
GHLMD

SEQ ID NO: 220 - protein, 5 aa, Artificial Sequence
  Description of Artificial Sequence: Synthetic peptide
DHLST

SEQ ID NO: 221 - protein, 5 aa, Artificial Sequence
  Description of Artificial Sequence: Synthetic peptide
EHLMV

SEQ ID NO: 222 - protein, 5 aa, Artificial Sequence
  Description of Artificial Sequence: Synthetic peptide
AHLVV

SEQ ID NO: 223 - protein, 5 aa, Artificial Sequence
  Description of Artificial Sequence: Synthetic peptide
EHLAV

SEQ ID NO: 224 - protein, 5 aa, Artificial Sequence
  Description of Artificial Sequence: Synthetic peptide
HTLAE

SEQ ID NO: 225 - protein, 5 aa, Artificial Sequence
  Description of Artificial Sequence: Synthetic peptide
STLQE

SEQ ID NO: 226 - protein, 5 aa, Artificial Sequence
  Description of Artificial Sequence: Synthetic peptide
DHLAE

SEQ ID NO: 227 - protein, 5 aa, Artificial Sequence
  Description of Artificial Sequence: Synthetic peptide
AHLQE

SEQ ID NO: 228 - protein, 5 aa, Artificial Sequence
  Description of Artificial Sequence: Synthetic peptide
SSLNE

SEQ ID NO: 229 - protein, 5 aa, Artificial Sequence
  Description of Artificial Sequence: Synthetic peptide
GHLNV

SEQ ID NO: 230 - protein, 5 aa, Artificial Sequence
  Description of Artificial Sequence: Synthetic peptide
EHLVE

SEQ ID NO: 231 - protein, 5 aa, Artificial Sequence
  Description of Artificial Sequence: Synthetic peptide
DHLME

SEQ ID NO: 232 - protein, 5 aa, Artificial Sequence
  Description of Artificial Sequence: Synthetic peptide
DHLRE

SEQ ID NO: 233 - protein, 5 aa, Artificial Sequence
  Description of Artificial Sequence: Synthetic peptide
AHLNA

SEQ ID NO: 234 - protein, 5 aa, Artificial Sequence
  Description of Artificial Sequence: Synthetic peptide
HTLVE

SEQ ID NO: 235 - protein, 5 aa, Artificial Sequence
  Description of Artificial Sequence: Synthetic peptide
STLKE

SEQ ID NO: 236 - protein, 5 aa, Artificial Sequence
  Description of Artificial Sequence: Synthetic peptide
EHLQV

SEQ ID NO: 237 - protein, 5 aa, Artificial Sequence
  Description of Artificial Sequence: Synthetic peptide
GTLME

SEQ ID NO: 238 - protein, 5 aa, Artificial Sequence
  Description of Artificial Sequence: Synthetic peptide
HHLAV

SEQ ID NO: 239 - protein, 5 aa, Artificial Sequence
  Description of Artificial Sequence: Synthetic peptide
HSLME

SEQ ID NO: 240 - protein, 5 aa, Artificial Sequence
  Description of Artificial Sequence: Synthetic peptide
HSLTE

SEQ ID NO: 241 - protein, 5 aa, Artificial Sequence
  Description of Artificial Sequence: Synthetic peptide
EHLMA

SEQ ID NO: 242 - protein, 5 aa, Artificial Sequence
  Description of Artificial Sequence: Synthetic peptide
DHLHT

SEQ ID NO: 243 - protein, 5 aa, Artificial Sequence
  Description of Artificial Sequence: Synthetic peptide
DHLTV

SEQ ID NO: 244 - protein, 5 aa, Artificial Sequence
  Description of Artificial Sequence: Synthetic peptide
EHLIV

SEQ ID NO: 245 - protein, 5 aa, Artificial Sequence
  Description of Artificial Sequence: Synthetic peptide
SGLNE

SEQ ID NO: 246 - protein, 5 aa, Artificial Sequence
  Description of Artificial Sequence: Synthetic peptide
AHLLV

SEQ ID NO: 247 - protein, 5 aa, Artificial Sequence
  Description of Artificial Sequence: Synthetic peptide
EHLLV

SEQ ID NO: 248 - protein, 5 aa, Artificial Sequence
  Description of Artificial Sequence: Synthetic peptide
VKLKI

SEQ ID NO: 249 - protein, 5 aa, Artificial Sequence
  Description of Artificial Sequence: Synthetic peptide
DHLQE

SEQ ID NO: 250 - protein, 5 aa, Artificial Sequence
  Description of Artificial Sequence: Synthetic peptide
HTLTE

SEQ ID NO: 251 - protein, 5 aa, Artificial Sequence
  Description of Artificial Sequence: Synthetic peptide
STLHE

SEQ ID NO: 252 - protein, 5 aa, Artificial Sequence
  Description of Artificial Sequence: Synthetic peptide
DHLVV

SEQ ID NO: 253 - protein, 5 aa, Artificial Sequence
  Description of Artificial Sequence: Synthetic peptide
AGLAL

SEQ ID NO: 254 - protein, 5 aa, Artificial Sequence
  Description of Artificial Sequence: Synthetic peptide
STLND

SEQ ID NO: 255 - protein, 5 aa, Artificial Sequence
  Description of Artificial Sequence: Synthetic peptide
DHLKA

SEQ ID NO: 256 - protein, 5 aa, Artificial Sequence
  Description of Artificial Sequence: Synthetic peptide
KDLTQ

SEQ ID NO: 257 - protein, 5 aa, Artificial Sequence
  Description of Artificial Sequence: Synthetic peptide
DKLMN

SEQ ID NO: 258 - protein, 5 aa, Artificial Sequence
  Description of Artificial Sequence: Synthetic peptide
GTLRE

SEQ ID NO: 259 - protein, 5 aa, Artificial Sequence
  Description of Artificial Sequence: Synthetic peptide
GHLTV

SEQ ID NO: 260 - protein, 5 aa, Artificial Sequence
  Description of Artificial Sequence: Synthetic peptide
RLLTA

SEQ ID NO: 261 - protein, 5 aa, Artificial Sequence
  Description of Artificial Sequence: Synthetic peptide
SSLRE

SEQ ID NO: 262 - protein, 5 aa, Artificial Sequence
  Description of Artificial Sequence: Synthetic peptide
HTLKE

SEQ ID NO: 263 - protein, 5 aa, Artificial Sequence
  Description of Artificial Sequence: Synthetic peptide
GHLAV

SEQ ID NO: 264 - protein, 5 aa, Artificial Sequence
  Description of Artificial Sequence: Synthetic peptide
RLLAQ

SEQ ID NO: 265 - protein, 5 aa, Artificial Sequence
  Description of Artificial Sequence: Synthetic peptide
KDLAV

SEQ ID NO: 266 - protein, 5 aa, Artificial Sequence
  Description of Artificial Sequence: Synthetic peptide
EHLQE

SEQ ID NO: 267 - protein, 5 aa, Artificial Sequence
  Description of Artificial Sequence: Synthetic peptide
SHLNV

SEQ ID NO: 268 - protein, 5 aa, Artificial Sequence
  Description of Artificial Sequence: Synthetic peptide
AGLPI

SEQ ID NO: 269 - protein, 5 aa, Artificial Sequence
  Description of Artificial Sequence: Synthetic peptide
TTLME

SEQ ID NO: 270 - protein, 5 aa, Artificial Sequence
  Description of Artificial Sequence: Synthetic peptide
AHLMV

SEQ ID NO: 271 - protein, 5 aa, Artificial Sequence
  Description of Artificial Sequence: Synthetic peptide
EHLME

SEQ ID NO: 272 - protein, 5 aa, Artificial Sequence
  Description of Artificial Sequence: Synthetic peptide
EHLQT

SEQ ID NO: 273 - protein, 5 aa, Artificial Sequence
  Description of Artificial Sequence: Synthetic peptide
EVLNR

SEQ ID NO: 274 - protein, 5 aa, Artificial Sequence
  Description of Artificial Sequence: Synthetic peptide
HHLVV

SEQ ID NO: 275 - protein, 5 aa, Artificial Sequence
  Description of Artificial Sequence: Synthetic peptide
KDLSV

SEQ ID NO: 276 - protein, 5 aa, Artificial Sequence
  Description of Artificial Sequence: Synthetic peptide
RHLVM

SEQ ID NO: 277 - protein, 5 aa, Artificial Sequence
  Description of Artificial Sequence: Synthetic peptide
THLNE

SEQ ID NO: 278 - protein, 5 aa, Artificial Sequence
  Description of Artificial Sequence: Synthetic peptide
RDLRT

SEQ ID NO: 279 - protein, 5 aa, Artificial Sequence
  Description of Artificial Sequence: Synthetic peptide
LLLGS

SEQ ID NO: 280 - protein, 5 aa, Artificial Sequence
  Description of Artificial Sequence: Synthetic peptide
MVLGN

SEQ ID NO: 281 - protein, 5 aa, Artificial Sequence
  Description of Artificial Sequence: Synthetic peptide
KTLIE

SEQ ID NO: 282 - protein, 5 aa, Artificial Sequence
  Description of Artificial Sequence: Synthetic peptide
AHLGV

SEQ ID NO: 283 - protein, 5 aa, Artificial Sequence
  Description of Artificial Sequence: Synthetic peptide
SGLLA

SEQ ID NO: 284 - protein, 5 aa, Artificial Sequence
  Description of Artificial Sequence: Synthetic peptide
DHLHV

SEQ ID NO: 285 - protein, 5 aa, Artificial Sequence
  Description of Artificial Sequence: Synthetic peptide
EHLNT

SEQ ID NO: 286 - protein, 5 aa, Artificial Sequence
  Description of Artificial Sequence: Synthetic peptide
STLLQ

SEQ ID NO: 287 - protein, 5 aa, Artificial Sequence
  Description of Artificial Sequence: Synthetic peptide
AHLKV

SEQ ID NO: 288 - protein, 5 aa, Artificial Sequence
  Description of Artificial Sequence: Synthetic peptide
AHLAV

SEQ ID NO: 289 - protein, 5 aa, Artificial Sequence
  Description of Artificial Sequence: Synthetic peptide
TNLID

SEQ ID NO: 290 - protein, 5 aa, Artificial Sequence
  Description of Artificial Sequence: Synthetic peptide
GTLNE

SEQ ID NO: 291 - protein, 5 aa, Artificial Sequence
  Description of Artificial Sequence: Synthetic peptide
QVLTQ

SEQ ID NO: 292 - protein, 5 aa, Artificial Sequence
  Description of Artificial Sequence: Synthetic peptide
SSLME

SEQ ID NO: 293 - protein, 5 aa, Artificial Sequence
  Description of Artificial Sequence: Synthetic peptide
GHLVE

SEQ ID NO: 294 - protein, 5 aa, Artificial Sequence
  Description of Artificial Sequence: Synthetic peptide
HSLLE

SEQ ID NO: 295 - protein, 5 aa, Artificial Sequence
  Description of Artificial Sequence: Synthetic peptide
SGLLE

SEQ ID NO: 296 - protein, 5 aa, Artificial Sequence
  Description of Artificial Sequence: Synthetic peptide
GGLLE

SEQ ID NO: 297 - protein, 5 aa, Artificial Sequence
  Description of Artificial Sequence: Synthetic peptide
STLRV

SEQ ID NO: 298 - protein, 5 aa, Artificial Sequence
  Description of Artificial Sequence: Synthetic peptide
HTLAD

SEQ ID NO: 299 - protein, 5 aa, Artificial Sequence
  Description of Artificial Sequence: Synthetic peptide
SHLME

SEQ ID NO: 300 - protein, 5 aa, Artificial Sequence
  Description of Artificial Sequence: Synthetic peptide
DHLAI

SEQ ID NO: 301 - protein, 5 aa, Artificial Sequence
  Description of Artificial Sequence: Synthetic peptide
EHLLA

SEQ ID NO: 302 - protein, 5 aa, Artificial Sequence
  Description of Artificial Sequence: Synthetic peptide
HNLLL

SEQ ID NO: 303 - protein, 5 aa, Artificial Sequence
  Description of Artificial Sequence: Synthetic peptide
PHLVV

SEQ ID NO: 304 - protein, 5 aa, Artificial Sequence
  Description of Artificial Sequence: Synthetic peptide
KALGT

SEQ ID NO: 305 - protein, 5 aa, Artificial Sequence
  Description of Artificial Sequence: Synthetic peptide
PHLVI

SEQ ID NO: 306 - protein, 5 aa, Artificial Sequence
  Description of Artificial Sequence: Synthetic peptide
VLLII

SEQ ID NO: 307 - protein, 5 aa, Artificial Sequence
  Description of Artificial Sequence: Synthetic peptide
HHLRE

SEQ ID NO: 308 - protein, 5 aa, Artificial Sequence
  Description of Artificial Sequence: Synthetic peptide
GALRM

SEQ ID NO: 309 - protein, 5 aa, Artificial Sequence
  Description of Artificial Sequence: Synthetic peptide
RGLHE

SEQ ID NO: 310 - protein, 5 aa, Artificial Sequence
  Description of Artificial Sequence: Synthetic peptide
AHLLE

SEQ ID NO: 311 - protein, 5 aa, Artificial Sequence
  Description of Artificial Sequence: Synthetic peptide
EHLKA

SEQ ID NO: 312 - protein, 5 aa, Artificial Sequence
  Description of Artificial Sequence: Synthetic peptide
DTLLV

SEQ ID NO: 313 - protein, 5 aa, Artificial Sequence
  Description of Artificial Sequence: Synthetic peptide
EHLRT

SEQ ID NO: 314 - protein, 5 aa, Artificial Sequence
  Description of Artificial Sequence: Synthetic peptide
SSLRD

SEQ ID NO: 315 - protein, 5 aa, Artificial Sequence
  Description of Artificial Sequence: Synthetic peptide
EHLAT

SEQ ID NO: 316 - protein, 5 aa, Artificial Sequence
  Description of Artificial Sequence: Synthetic peptide
SGLGE

SEQ ID NO: 317 - protein, 5 aa, Artificial Sequence
  Description of Artificial Sequence: Synthetic peptide
ATLQE

SEQ ID NO: 318 - protein, 5 aa, Artificial Sequence
  Description of Artificial Sequence: Synthetic peptide
DHLSA

SEQ ID NO: 319 - protein, 5 aa, Artificial Sequence
  Description of Artificial Sequence: Synthetic peptide
SHLLV

SEQ ID NO: 320 - protein, 5 aa, Artificial Sequence
  Description of Artificial Sequence: Synthetic peptide
KDLMV

SEQ ID NO: 321 - protein, 5 aa, Artificial Sequence
  Description of Artificial Sequence: Synthetic peptide
DHLQQ

SEQ ID NO: 322 - protein, 5 aa, Artificial Sequence
  Description of Artificial Sequence: Synthetic peptide
ATLME

SEQ ID NO: 323 - protein, 5 aa, Artificial Sequence
  Description of Artificial Sequence: Synthetic peptide
GHLQA

SEQ ID NO: 324 - protein, 5 aa, Artificial Sequence
  Description of Artificial Sequence: Synthetic peptide
RTLTE

SEQ ID NO: 325 - protein, 5 aa, Artificial Sequence
  Description of Artificial Sequence: Synthetic peptide
RRLAH

SEQ ID NO: 326 - protein, 5 aa, Artificial Sequence
  Description of Artificial Sequence: Synthetic peptide
DTLQA

SEQ ID NO: 327 - protein, 5 aa, Artificial Sequence
  Description of Artificial Sequence: Synthetic peptide
GHLEV

SEQ ID NO: 328 - protein, 5 aa, Artificial Sequence
  Description of Artificial Sequence: Synthetic peptide
HQLKL

SEQ ID NO: 329 - protein, 5 aa, Artificial Sequence
  Description of Artificial Sequence: Synthetic peptide
EHLLT

SEQ ID NO: 330 - protein, 5 aa, Artificial Sequence
  Description of Artificial Sequence: Synthetic peptide
DGLRT

SEQ ID NO: 331 - protein, 5 aa, Artificial Sequence
  Description of Artificial Sequence: Synthetic peptide
THLRP

SEQ ID NO: 332 - protein, 5 aa, Artificial Sequence
  Description of Artificial Sequence: Synthetic peptide
EHLNA

SEQ ID NO: 333 - protein, 5 aa, Artificial Sequence
  Description of Artificial Sequence: Synthetic peptide
STLVV

SEQ ID NO: 334 - protein, 5 aa, Artificial Sequence
  Description of Artificial Sequence: Synthetic peptide
DTLLA

SEQ ID NO: 335 - protein, 5 aa, Artificial Sequence
  Description of Artificial Sequence: Synthetic peptide
STLDE

SEQ ID NO: 336 - protein, 5 aa, Artificial Sequence
  Description of Artificial Sequence: Synthetic peptide
KDLVA

SEQ ID NO: 337 - protein, 5 aa, Artificial Sequence
  Description of Artificial Sequence: Synthetic peptide
AHLHA

SEQ ID NO: 338 - protein, 5 aa, Artificial Sequence
  Description of Artificial Sequence: Synthetic peptide
KDLQV

SEQ ID NO: 339 - protein, 5 aa, Artificial Sequence
  Description of Artificial Sequence: Synthetic peptide
HHLTV

SEQ ID NO: 340 - protein, 5 aa, Artificial Sequence
  Description of Artificial Sequence: Synthetic peptide
SGLLD

SEQ ID NO: 341 - protein, 5 aa, Artificial Sequence
  Description of Artificial Sequence: Synthetic peptide
ANLME

SEQ ID NO: 342 - protein, 5 aa, Artificial Sequence
  Description of Artificial Sequence: Synthetic peptide
EHLKT

SEQ ID NO: 343 - protein, 5 aa, Artificial Sequence
  Description of Artificial Sequence: Synthetic peptide
GSLAI

SEQ ID NO: 344 - protein, 5 aa, Artificial Sequence
  Description of Artificial Sequence: Synthetic peptide
EHLSV

SEQ ID NO: 345 - protein, 5 aa, Artificial Sequence
  Description of Artificial Sequence: Synthetic peptide
EHLNE

SEQ ID NO: 346 - protein, 5 aa, Artificial Sequence
  Description of Artificial Sequence: Synthetic peptide
EHLVI

SEQ ID NO: 347 - protein, 5 aa, Artificial Sequence
  Description of Artificial Sequence: Synthetic peptide
KDLKV

SEQ ID NO: 348 - protein, 5 aa, Artificial Sequence
  Description of Artificial Sequence: Synthetic peptide
EGLGT

SEQ ID NO: 349 - protein, 5 aa, Artificial Sequence
  Description of Artificial Sequence: Synthetic peptide
STLMS

SEQ ID NO: 350 - protein, 5 aa, Artificial Sequence
  Description of Artificial Sequence: Synthetic peptide
AHLMM

SEQ ID NO: 351 - protein, 5 aa, Artificial Sequence
  Description of Artificial Sequence: Synthetic peptide
IKLDG

SEQ ID NO: 352 - protein, 5 aa, Artificial Sequence
  Description of Artificial Sequence: Synthetic peptide
VLLGA

SEQ ID NO: 353 - protein, 5 aa, Artificial Sequence
  Description of Artificial Sequence: Synthetic peptide
PGLSA

SEQ ID NO: 354 - protein, 5 aa, Artificial Sequence
  Description of Artificial Sequence: Synthetic peptide
AELNR

SEQ ID NO: 355 - protein, 5 aa, Artificial Sequence
  Description of Artificial Sequence: Synthetic peptide
HQLVI

SEQ ID NO: 356 - protein, 5 aa, Artificial Sequence
  Description of Artificial Sequence: Synthetic peptide
GHLVV

SEQ ID NO: 357 - protein, 5 aa, Artificial Sequence
  Description of Artificial Sequence: Synthetic peptide
PHLLV

SEQ ID NO: 358 - protein, 5 aa, Artificial Sequence
  Description of Artificial Sequence: Synthetic peptide
PRLAL

SEQ ID NO: 359 - protein, 5 aa, Artificial Sequence
  Description of Artificial Sequence: Synthetic peptide
DHLNA

SEQ ID NO: 360 - protein, 5 aa, Artificial Sequence
  Description of Artificial Sequence: Synthetic peptide
KDLDV

SEQ ID NO: 361 - protein, 5 aa, Artificial Sequence
  Description of Artificial Sequence: Synthetic peptide
AHLHV

SEQ ID NO: 362 - protein, 5 aa, Artificial Sequence
  Description of Artificial Sequence: Synthetic peptide
RVLGG

SEQ ID NO: 363 - protein, 5 aa, Artificial Sequence
  Description of Artificial Sequence: Synthetic peptide
AHLQA

SEQ ID NO: 364 - protein, 5 aa, Artificial Sequence
  Description of Artificial Sequence: Synthetic peptide
RQLRT

SEQ ID NO: 365 - protein, 5 aa, Artificial Sequence
  Description of Artificial Sequence: Synthetic peptide
AHLQT

SEQ ID NO: 366 - protein, 5 aa, Artificial Sequence
  Description of Artificial Sequence: Synthetic peptide
EHLAM

SEQ ID NO: 367 - protein, 5 aa, Artificial Sequence
  Description of Artificial Sequence: Synthetic peptide
DRLSI

SEQ ID NO: 368 - protein, 5 aa, Artificial Sequence
  Description of Artificial Sequence: Synthetic peptide
GGLGA

SEQ ID NO: 369 - protein, 5 aa, Artificial Sequence
  Description of Artificial Sequence: Synthetic peptide
GHLNT

SEQ ID NO: 370 - protein, 5 aa, Artificial Sequence
  Description of Artificial Sequence: Synthetic peptide
AHLRT

SEQ ID NO: 371 - protein, 5 aa, Artificial Sequence
  Description of Artificial Sequence: Synthetic peptide
DTLRV

SEQ ID NO: 372 - protein, 5 aa, Artificial Sequence
  Description of Artificial Sequence: Synthetic peptide
MSLRG

SEQ ID NO: 373 - protein, 5 aa, Artificial Sequence
  Description of Artificial Sequence: Synthetic peptide
DHLTI

SEQ ID NO: 374 - protein, 5 aa, Artificial Sequence
  Description of Artificial Sequence: Synthetic peptide
THLIV

SEQ ID NO: 375 - protein, 5 aa, Artificial Sequence
  Description of Artificial Sequence: Synthetic peptide
DTLMA

SEQ ID NO: 376 - protein, 5 aa, Artificial Sequence
  Description of Artificial Sequence: Synthetic peptide
MKLQE

SEQ ID NO: 377 - protein, 5 aa, Artificial Sequence
  Description of Artificial Sequence: Synthetic peptide
TALGT

SEQ ID NO: 378 - protein, 5 aa, Artificial Sequence
  Description of Artificial Sequence: Synthetic peptide
GHLLV

SEQ ID NO: 379 - protein, 5 aa, Artificial Sequence
  Description of Artificial Sequence: Synthetic peptide
GQLAI

SEQ ID NO: 380 - protein, 5 aa, Artificial Sequence
  Description of Artificial Sequence: Synthetic peptide
ANLES

SEQ ID NO: 381 - protein, 5 aa, Artificial Sequence
  Description of Artificial Sequence: Synthetic peptide
AHLNT

SEQ ID NO: 382 - protein, 5 aa, Artificial Sequence
  Description of Artificial Sequence: Synthetic peptide
EHLLE

SEQ ID NO: 383 - protein, 5 aa, Artificial Sequence
  Description of Artificial Sequence: Synthetic peptide
SNLTV

SEQ ID NO: 384 - protein, 5 aa, Artificial Sequence
  Description of Artificial Sequence: Synthetic peptide
STLLV

SEQ ID NO: 385 - protein, 5 aa, Artificial Sequence
  Description of Artificial Sequence: Synthetic peptide
STLMV

SEQ ID NO: 386 - protein, 5 aa, Artificial Sequence
  Description of Artificial Sequence: Synthetic peptide
GTLVS

SEQ ID NO: 387 - protein, 5 aa, Artificial Sequence
  Description of Artificial Sequence: Synthetic peptide
DNLKT

SEQ ID NO: 388 - protein, 5 aa, Artificial Sequence
  Description of Artificial Sequence: Synthetic peptide
GHLQT

SEQ ID NO: 389 - protein, 5 aa, Artificial Sequence
  Description of Artificial Sequence: Synthetic peptide
EHLVT

SEQ ID NO: 390 - protein, 5 aa, Artificial Sequence
  Description of Artificial Sequence: Synthetic peptide
GALRE

SEQ ID NO: 391 - protein, 5 aa, Artificial Sequence
  Description of Artificial Sequence: Synthetic peptide
SSLAE

SEQ ID NO: 392 - protein, 5 aa, Artificial Sequence
  Description of Artificial Sequence: Synthetic peptide
DTLRQ

SEQ ID NO: 393 - protein, 5 aa, Artificial Sequence
  Description of Artificial Sequence: Synthetic peptide
KALLG

SEQ ID NO: 394 - protein, 5 aa, Artificial Sequence
  Description of Artificial Sequence: Synthetic peptide
AMLNP

SEQ ID NO: 395 - protein, 5 aa, Artificial Sequence
  Description of Artificial Sequence: Synthetic peptide
DTLHQ

SEQ ID NO: 396 - protein, 5 aa, Artificial Sequence
  Description of Artificial Sequence: Synthetic peptide
DNLLQ

SEQ ID NO: 397 - protein, 5 aa, Artificial Sequence
  Description of Artificial Sequence: Synthetic peptide
EHLAH

SEQ ID NO: 398 - protein, 5 aa, Artificial Sequence
  Description of Artificial Sequence: Synthetic peptide
AHLKE

SEQ ID NO: 399 - protein, 5 aa, Artificial Sequence
  Description of Artificial Sequence: Synthetic peptide
ATLAE

SEQ ID NO: 400 - protein, 5 aa, Artificial Sequence
  Description of Artificial Sequence: Synthetic peptide
EHLMD

SEQ ID NO: 401 - protein, 5 aa, Artificial Sequence
  Description of Artificial Sequence: Synthetic peptide
STLHM

SEQ ID NO: 402 - protein, 5 aa, Artificial Sequence
  Description of Artificial Sequence: Synthetic peptide
DTLAV

SEQ ID NO: 403 - protein, 5 aa, Artificial Sequence
  Description of Artificial Sequence: Synthetic peptide
DHLVE

SEQ ID NO: 404 - protein, 5 aa, Artificial Sequence
  Description of Artificial Sequence: Synthetic peptide
PTLGE

SEQ ID NO: 405 - protein, 5 aa, Artificial Sequence
  Description of Artificial Sequence: Synthetic peptide
KGLPL

SEQ ID NO: 406 - protein, 5 aa, Artificial Sequence
  Description of Artificial Sequence: Synthetic peptide
DTLLQ

SEQ ID NO: 407 - protein, 5 aa, Artificial Sequence
  Description of Artificial Sequence: Synthetic peptide
AHLNE

SEQ ID NO: 408 - protein, 5 aa, Artificial Sequence
  Description of Artificial Sequence: Synthetic peptide
AHLAE

SEQ ID NO: 409 - protein, 5 aa, Artificial Sequence
  Description of Artificial Sequence: Synthetic peptide
GHLKV

SEQ ID NO: 410 - protein, 5 aa, Artificial Sequence
  Description of Artificial Sequence: Synthetic peptide
SGLQV

SEQ ID NO: 411 - protein, 5 aa, Artificial Sequence
  Description of Artificial Sequence: Synthetic peptide
HHLLV

SEQ ID NO: 412 - protein, 5 aa, Artificial Sequence
  Description of Artificial Sequence: Synthetic peptide
EPLLP

SEQ ID NO: 413 - protein, 5 aa, Artificial Sequence
  Description of Artificial Sequence: Synthetic peptide
DNLAV

SEQ ID NO: 414 - protein, 5 aa, Artificial Sequence
  Description of Artificial Sequence: Synthetic peptide
AHLLT

SEQ ID NO: 415 - protein, 5 aa, Artificial Sequence
  Description of Artificial Sequence: Synthetic peptide
AHLST

SEQ ID NO: 416 - protein, 5 aa, Artificial Sequence
  Description of Artificial Sequence: Synthetic peptide
DNLRT

SEQ ID NO: 417 - protein, 5 aa, Artificial Sequence
  Description of Artificial Sequence: Synthetic peptide
DTLAL

SEQ ID NO: 418 - protein, 5 aa, Artificial Sequence
  Description of Artificial Sequence: Synthetic peptide
DTLQV

SEQ ID NO: 419 - protein, 5 aa, Artificial Sequence
  Description of Artificial Sequence: Synthetic peptide
EHLRA

SEQ ID NO: 420 - protein, 5 aa, Artificial Sequence
  Description of Artificial Sequence: Synthetic peptide
SNLQV

SEQ ID NO: 421 - protein, 5 aa, Artificial Sequence
  Description of Artificial Sequence: Synthetic peptide
KDLRV

SEQ ID NO: 422 - protein, 5 aa, Artificial Sequence
  Description of Artificial Sequence: Synthetic peptide
DTLAT

SEQ ID NO: 423 - protein, 5 aa, Artificial Sequence
  Description of Artificial Sequence: Synthetic peptide
DTLRA

SEQ ID NO: 424 - protein, 5 aa, Artificial Sequence
  Description of Artificial Sequence: Synthetic peptide
QHLRV

SEQ ID NO: 425 - protein, 5 aa, Artificial Sequence
  Description of Artificial Sequence: Synthetic peptide
SSLLE

SEQ ID NO: 426 - protein, 5 aa, Artificial Sequence
  Description of Artificial Sequence: Synthetic peptide
SNLMV

SEQ ID NO: 427 - protein, 5 aa, Artificial Sequence
  Description of Artificial Sequence: Synthetic peptide
SDLGG

SEQ ID NO: 428 - protein, 5 aa, Artificial Sequence
  Description of Artificial Sequence: Synthetic peptide
DNLHT

SEQ ID NO: 429 - protein, 5 aa, Artificial Sequence
  Description of Artificial Sequence: Synthetic peptide
DNLTA

SEQ ID NO: 430 - protein, 5 aa, Artificial Sequence
  Description of Artificial Sequence: Synthetic peptide
DTLMV

SEQ ID NO: 431 - protein, 5 aa, Artificial Sequence
  Description of Artificial Sequence: Synthetic peptide
EHLST

SEQ ID NO: 432 - protein, 5 aa, Artificial Sequence
  Description of Artificial Sequence: Synthetic peptide
DTLSV

SEQ ID NO: 433 - protein, 5 aa, Artificial Sequence
  Description of Artificial Sequence: Synthetic peptide
EHLVM

SEQ ID NO: 434 - protein, 5 aa, Artificial Sequence
  Description of Artificial Sequence: Synthetic peptide
STLAE

SEQ ID NO: 435 - protein, 5 aa, Artificial Sequence
  Description of Artificial Sequence: Synthetic peptide
KDLAE

SEQ ID NO: 436 - protein, 5 aa, Artificial Sequence
  Description of Artificial Sequence: Synthetic peptide
SSLNV

SEQ ID NO: 437 - protein, 5 aa, Artificial Sequence
  Description of Artificial Sequence: Synthetic peptide
SSLLV

SEQ ID NO: 438 - protein, 5 aa, Artificial Sequence
  Description of Artificial Sequence: Synthetic peptide
AHLKT

SEQ ID NO: 439 - protein, 5 aa, Artificial Sequence
  Description of Artificial Sequence: Synthetic peptide
AHLRE

SEQ ID NO: 440 - protein, 5 aa, Artificial Sequence
  Description of Artificial Sequence: Synthetic peptide
KDLLV

SEQ ID NO: 441 - protein, 5 aa, Artificial Sequence
  Description of Artificial Sequence: Synthetic peptide
DSLLV

SEQ ID NO: 442 - protein, 5 aa, Artificial Sequence
  Description of Artificial Sequence: Synthetic peptide
DTLLM

SEQ ID NO: 443 - protein, 5 aa, Artificial Sequence
  Description of Artificial Sequence: Synthetic peptide
DTLLI

SEQ ID NO: 444 - protein, 5 aa, Artificial Sequence
  Description of Artificial Sequence: Synthetic peptide
DTLTQ

SEQ ID NO: 445 - protein, 5 aa, Artificial Sequence
  Description of Artificial Sequence: Synthetic peptide
DTLAA

SEQ ID NO: 446 - protein, 5 aa, Artificial Sequence
  Description of Artificial Sequence: Synthetic peptide
DTLSA

SEQ ID NO: 447 - protein, 5 aa, Artificial Sequence
  Description of Artificial Sequence: Synthetic peptide
DTLKA

SEQ ID NO: 448 - protein, 5 aa, Artificial Sequence
  Description of Artificial Sequence: Synthetic peptide
STLQQ

SEQ ID NO: 449 - protein, 5 aa, Artificial Sequence
  Description of Artificial Sequence: Synthetic peptide
DTLQQ

SEQ ID NO: 450 - protein, 5 aa, Artificial Sequence
  Description of Artificial Sequence: Synthetic peptide
DTLLL

SEQ ID NO: 451 - protein, 5 aa, Artificial Sequence
  Description of Artificial Sequence: Synthetic peptide
DTLMQ

SEQ ID NO: 452 - protein, 5 aa, Artificial Sequence
  Description of Artificial Sequence: Synthetic peptide
DTLNA

SEQ ID NO: 453 - protein, 5 aa, Artificial Sequence
  Description of Artificial Sequence: Synthetic peptide
STLLA

SEQ ID NO: 454 - protein, 5 aa, Artificial Sequence
  Description of Artificial Sequence: Synthetic peptide
DTLKV

SEQ ID NO: 455 - protein, 5 aa, Artificial Sequence
  Description of Artificial Sequence: Synthetic peptide
STLNA

SEQ ID NO: 456 - protein, 5 aa, Artificial Sequence
  Description of Artificial Sequence: Synthetic peptide
DTLRE

SEQ ID NO: 457 - protein, 5 aa, Artificial Sequence
  Description of Artificial Sequence: Synthetic peptide
DTLTA

SEQ ID NO: 458 - protein, 5 aa, Artificial Sequence
  Description of Artificial Sequence: Synthetic peptide
DTLQD

SEQ ID NO: 459 - protein, 5 aa, Artificial Sequence
  Description of Artificial Sequence: Synthetic peptide
DTLVA

SEQ ID NO: 460 - protein, 5 aa, Artificial Sequence
  Description of Artificial Sequence: Synthetic peptide
DTLLS

SEQ ID NO: 461 - protein, 5 aa, Artificial Sequence
  Description of Artificial Sequence: Synthetic peptide
STLTQ

SEQ ID NO: 462 - protein, 5 aa, Artificial Sequence
  Description of Artificial Sequence: Synthetic peptide
DSLLA

SEQ ID NO: 463 - protein, 5 aa, Artificial Sequence
  Description of Artificial Sequence: Synthetic peptide
DTLRT

SEQ ID NO: 464 - protein, 5 aa, Artificial Sequence
  Description of Artificial Sequence: Synthetic peptide
DTLQI

SEQ ID NO: 465 - protein, 5 aa, Artificial Sequence
  Description of Artificial Sequence: Synthetic peptide
DTLMN

SEQ ID NO: 466 - protein, 5 aa, Artificial Sequence
  Description of Artificial Sequence: Synthetic peptide
STLSE

SEQ ID NO: 467 - protein, 5 aa, Artificial Sequence
  Description of Artificial Sequence: Synthetic peptide
SSLQV

SEQ ID NO: 468 - protein, 5 aa, Artificial Sequence
  Description of Artificial Sequence: Synthetic peptide
TNLAV

SEQ ID NO: 469 - protein, 5 aa, Artificial Sequence
  Description of Artificial Sequence: Synthetic peptide
DTLVV

SEQ ID NO: 470 - protein, 5 aa, Artificial Sequence
  Description of Artificial Sequence: Synthetic peptide
DTLHA

SEQ ID NO: 471 - protein, 5 aa, Artificial Sequence
  Description of Artificial Sequence: Synthetic peptide
DTLMT

SEQ ID NO: 472 - protein, 5 aa, Artificial Sequence
  Description of Artificial Sequence: Synthetic peptide
DSLRV

SEQ ID NO: 473 - protein, 5 aa, Artificial Sequence
  Description of Artificial Sequence: Synthetic peptide
DTLAE

SEQ ID NO: 474 - protein, 5 aa, Artificial Sequence
  Description of Artificial Sequence: Synthetic peptide
STLNV

SEQ ID NO: 475 - protein, 5 aa, Artificial Sequence
  Description of Artificial Sequence: Synthetic peptide
DTLRN

SEQ ID NO: 476 - protein, 5 aa, Artificial Sequence
  Description of Artificial Sequence: Synthetic peptide
DTLNV

SEQ ID NO: 477 - protein, 5 aa, Artificial Sequence
  Description of Artificial Sequence: Synthetic peptide
DTLRD

SEQ ID NO: 478 - protein, 5 aa, Artificial Sequence
  Description of Artificial Sequence: Synthetic peptide
DSLAV

SEQ ID NO: 479 - protein, 5 aa, Artificial Sequence
  Description of Artificial Sequence: Synthetic peptide
DTLVQ

SEQ ID NO: 480 - protein, 5 aa, Artificial Sequence
  Description of Artificial Sequence: Synthetic peptide
DTLQE

SEQ ID NO: 481 - protein, 5 aa, Artificial Sequence
  Description of Artificial Sequence: Synthetic peptide
STLLD

SEQ ID NO: 482 - protein, 5 aa, Artificial Sequence
  Description of Artificial Sequence: Synthetic peptide
DTLTH

SEQ ID NO: 483 - protein, 5 aa, Artificial Sequence
  Description of Artificial Sequence: Synthetic peptide
SSLND

SEQ ID NO: 484 - protein, 5 aa, Artificial Sequence
  Description of Artificial Sequence: Synthetic peptide
STLTV

SEQ ID NO: 485 - protein, 5 aa, Artificial Sequence
  Description of Artificial Sequence: Synthetic peptide
DTLML

SEQ ID NO: 486 - protein, 5 aa, Artificial Sequence
  Description of Artificial Sequence: Synthetic peptide
STLQA

SEQ ID NO: 487 - protein, 5 aa, Artificial Sequence
  Description of Artificial Sequence: Synthetic peptide
DTLLD

SEQ ID NO: 488 - protein, 5 aa, Artificial Sequence
  Description of Artificial Sequence: Synthetic peptide
DTLKQ

SEQ ID NO: 489 - protein, 5 aa, Artificial Sequence
  Description of Artificial Sequence: Synthetic peptide
DTLLT

SEQ ID NO: 490 - protein, 5 aa, Artificial Sequence
  Description of Artificial Sequence: Synthetic peptide
DTLII

SEQ ID NO: 491 - protein, 5 aa, Artificial Sequence
  Description of Artificial Sequence: Synthetic peptide
DTLLN

SEQ ID NO: 492 - protein, 5 aa, Artificial Sequence
  Description of Artificial Sequence: Synthetic peptide
DSLLQ

SEQ ID NO: 493 - protein, 5 aa, Artificial Sequence
  Description of Artificial Sequence: Synthetic peptide
STLEQ

SEQ ID NO: 494 - protein, 5 aa, Artificial Sequence
  Description of Artificial Sequence: Synthetic peptide
DTLGV

SEQ ID NO: 495 - protein, 5 aa, Artificial Sequence
  Description of Artificial Sequence: Synthetic peptide
DVLRE

SEQ ID NO: 496 - protein, 5 aa, Artificial Sequence
  Description of Artificial Sequence: Synthetic peptide
STLSA

SEQ ID NO: 497 - protein, 5 aa, Artificial Sequence
  Description of Artificial Sequence: Synthetic peptide
DSLSV

SEQ ID NO: 498 - protein, 5 aa, Artificial Sequence
  Description of Artificial Sequence: Synthetic peptide
DTLLE

SEQ ID NO: 499 - protein, 5 aa, Artificial Sequence
  Description of Artificial Sequence: Synthetic peptide
STLAA

SEQ ID NO: 500 - protein, 5 aa, Artificial Sequence
  Description of Artificial Sequence: Synthetic peptide
DTLKI

SEQ ID NO: 501 - protein, 5 aa, Artificial Sequence
  Description of Artificial Sequence: Synthetic peptide
DTLKM

SEQ ID NO: 502 - protein, 5 aa, Artificial Sequence
  Description of Artificial Sequence: Synthetic peptide
DTLQN

SEQ ID NO: 503 - protein, 5 aa, Artificial Sequence
  Description of Artificial Sequence: Synthetic peptide
TTLMT

SEQ ID NO: 504 - protein, 5 aa, Artificial Sequence
  Description of Artificial Sequence: Synthetic peptide
TTLAE

SEQ ID NO: 505 - protein, 5 aa, Artificial Sequence
  Description of Artificial Sequence: Synthetic peptide
STLTE

SEQ ID NO: 506 - protein, 5 aa, Artificial Sequence
  Description of Artificial Sequence: Synthetic peptide
VELVQ

SEQ ID NO: 507 - protein, 5 aa, Artificial Sequence
  Description of Artificial Sequence: Synthetic peptide
TTLNQ

SEQ ID NO: 508 - protein, 5 aa, Artificial Sequence
  Description of Artificial Sequence: Synthetic peptide
DTLMI

SEQ ID NO: 509 - protein, 5 aa, Artificial Sequence
  Description of Artificial Sequence: Synthetic peptide
TTLMD

SEQ ID NO: 510 - protein, 5 aa, Artificial Sequence
  Description of Artificial Sequence: Synthetic peptide
STLMA

SEQ ID NO: 511 - protein, 5 aa, Artificial Sequence
  Description of Artificial Sequence: Synthetic peptide
DVLLA

SEQ ID NO: 512 - protein, 5 aa, Artificial Sequence
  Description of Artificial Sequence: Synthetic peptide
DVLLT

SEQ ID NO: 513 - protein, 5 aa, Artificial Sequence
  Description of Artificial Sequence: Synthetic peptide
TTLNE

SEQ ID NO: 514 - protein, 5 aa, Artificial Sequence
  Description of Artificial Sequence: Synthetic peptide
MTLPT

SEQ ID NO: 515 - protein, 5 aa, Artificial Sequence
  Description of Artificial Sequence: Synthetic peptide
HTLVV

SEQ ID NO: 516 - protein, 5 aa, Artificial Sequence
  Description of Artificial Sequence: Synthetic peptide
ATLTQ

SEQ ID NO: 517 - protein, 5 aa, Artificial Sequence
  Description of Artificial Sequence: Synthetic peptide
STLAS

SEQ ID NO: 518 - protein, 5 aa, Artificial Sequence
  Description of Artificial Sequence: Synthetic peptide
SSLVE

SEQ ID NO: 519 - protein, 5 aa, Artificial Sequence
  Description of Artificial Sequence: Synthetic peptide
DALQA

SEQ ID NO: 520 - protein, 5 aa, Artificial Sequence
  Description of Artificial Sequence: Synthetic peptide
DVLDA

SEQ ID NO: 521 - protein, 5 aa, Artificial Sequence
  Description of Artificial Sequence: Synthetic peptide
GSLMQ

SEQ ID NO: 522 - protein, 5 aa, Artificial Sequence
  Description of Artificial Sequence: Synthetic peptide
DTLTM

SEQ ID NO: 523 - protein, 5 aa, Artificial Sequence
  Description of Artificial Sequence: Synthetic peptide
STLAQ

SEQ ID NO: 524 - protein, 5 aa, Artificial Sequence
  Description of Artificial Sequence: Synthetic peptide
STLMI

SEQ ID NO: 525 - protein, 5 aa, Artificial Sequence
  Description of Artificial Sequence: Synthetic peptide
DTLAM

SEQ ID NO: 526 - protein, 5 aa, Artificial Sequence
  Description of Artificial Sequence: Synthetic peptide
DTLHT

SEQ ID NO: 527 - protein, 5 aa, Artificial Sequence
  Description of Artificial Sequence: Synthetic peptide
DTLQL

SEQ ID NO: 528 - protein, 5 aa, Artificial Sequence
  Description of Artificial Sequence: Synthetic peptide
DSLKQ

SEQ ID NO: 529 - protein, 5 aa, Artificial Sequence
  Description of Artificial Sequence: Synthetic peptide
DSLRA

SEQ ID NO: 530 - protein, 5 aa, Artificial Sequence
  Description of Artificial Sequence: Synthetic peptide
STLHV

SEQ ID NO: 531 - protein, 5 aa, Artificial Sequence
  Description of Artificial Sequence: Synthetic peptide
STLMQ

SEQ ID NO: 532 - protein, 5 aa, Artificial Sequence
  Description of Artificial Sequence: Synthetic peptide
DGLMA

SEQ ID NO: 533 - protein, 5 aa, Artificial Sequence
  Description of Artificial Sequence: Synthetic peptide
DTLRL

SEQ ID NO: 534 - protein, 5 aa, Artificial Sequence
  Description of Artificial Sequence: Synthetic peptide
SSLLT

SEQ ID NO: 535 - protein, 5 aa, Artificial Sequence
  Description of Artificial Sequence: Synthetic peptide
DSLQA

SEQ ID NO: 536 - protein, 5 aa, Artificial Sequence
  Description of Artificial Sequence: Synthetic peptide
DTLRI

SEQ ID NO: 537 - protein, 5 aa, Artificial Sequence
  Description of Artificial Sequence: Synthetic peptide
STLGE

SEQ ID NO: 538 - protein, 5 aa, Artificial Sequence
  Description of Artificial Sequence: Synthetic peptide
DALKE

SEQ ID NO: 539 - protein, 5 aa, Artificial Sequence
  Description of Artificial Sequence: Synthetic peptide
STLRA

SEQ ID NO: 540 - protein, 5 aa, Artificial Sequence
  Description of Artificial Sequence: Synthetic peptide
DTLHH

SEQ ID NO: 541 - protein, 5 aa, Artificial Sequence
  Description of Artificial Sequence: Synthetic peptide
DTLRG

SEQ ID NO: 542 - protein, 5 aa, Artificial Sequence
  Description of Artificial Sequence: Synthetic peptide
DTLRM

SEQ ID NO: 543 - protein, 5 aa, Artificial Sequence
  Description of Artificial Sequence: Synthetic peptide
DVLMT

SEQ ID NO: 544 - protein, 5 aa, Artificial Sequence
  Description of Artificial Sequence: Synthetic peptide
DTLEI

SEQ ID NO: 545 - protein, 5 aa, Artificial Sequence
  Description of Artificial Sequence: Synthetic peptide
DTLHV

SEQ ID NO: 546 - protein, 5 aa, Artificial Sequence
  Description of Artificial Sequence: Synthetic peptide
GTLDE

SEQ ID NO: 547 - protein, 5 aa, Artificial Sequence
  Description of Artificial Sequence: Synthetic peptide
SSLAV

SEQ ID NO: 548 - protein, 5 aa, Artificial Sequence
  Description of Artificial Sequence: Synthetic peptide
STLKQ

SEQ ID NO: 549 - protein, 5 aa, Artificial Sequence
  Description of Artificial Sequence: Synthetic peptide
DTLMD

SEQ ID NO: 550 - protein, 5 aa, Artificial Sequence
  Description of Artificial Sequence: Synthetic peptide
GTLQT

SEQ ID NO: 551 - protein, 5 aa, Artificial Sequence
  Description of Artificial Sequence: Synthetic peptide
SSLVQ

SEQ ID NO: 552 - protein, 5 aa, Artificial Sequence
  Description of Artificial Sequence: Synthetic peptide
LMLMG

SEQ ID NO: 553 - protein, 5 aa, Artificial Sequence
  Description of Artificial Sequence: Synthetic peptide
STLRQ

SEQ ID NO: 554 - protein, 5 aa, Artificial Sequence
  Description of Artificial Sequence: Synthetic peptide
STLTA

SEQ ID NO: 555 - protein, 5 aa, Artificial Sequence
  Description of Artificial Sequence: Synthetic peptide
DSLVA

SEQ ID NO: 556 - protein, 5 aa, Artificial Sequence
  Description of Artificial Sequence: Synthetic peptide
SSLRV

SEQ ID NO: 557 - protein, 5 aa, Artificial Sequence
  Description of Artificial Sequence: Synthetic peptide
DSLRE

SEQ ID NO: 558 - protein, 5 aa, Artificial Sequence
  Description of Artificial Sequence: Synthetic peptide
GRLQD

SEQ ID NO: 559 - protein, 5 aa, Artificial Sequence
  Description of Artificial Sequence: Synthetic peptide
MALQD

SEQ ID NO: 560 - protein, 5 aa, Artificial Sequence
  Description of Artificial Sequence: Synthetic peptide
STLLH

SEQ ID NO: 561 - protein, 5 aa, Artificial Sequence
  Description of Artificial Sequence: Synthetic peptide
STLVQ

SEQ ID NO: 562 - protein, 5 aa, Artificial Sequence
  Description of Artificial Sequence: Synthetic peptide
VRLTA

SEQ ID NO: 563 - protein, 5 aa, Artificial Sequence
  Description of Artificial Sequence: Synthetic peptide
AVLGD

SEQ ID NO: 564 - protein, 5 aa, Artificial Sequence
  Description of Artificial Sequence: Synthetic peptide
PILVT

SEQ ID NO: 565 - protein, 5 aa, Artificial Sequence
  Description of Artificial Sequence: Synthetic peptide
STLDD

SEQ ID NO: 566 - protein, 5 aa, Artificial Sequence
  Description of Artificial Sequence: Synthetic peptide
DSLMI

SEQ ID NO: 567 - protein, 5 aa, Artificial Sequence
  Description of Artificial Sequence: Synthetic peptide
STLID

SEQ ID NO: 568 - protein, 5 aa, Artificial Sequence
  Description of Artificial Sequence: Synthetic peptide
TKLDT

SEQ ID NO: 569 - protein, 5 aa, Artificial Sequence
  Description of Artificial Sequence: Synthetic peptide
ATLVA

SEQ ID NO: 570 - protein, 5 aa, Artificial Sequence
  Description of Artificial Sequence: Synthetic peptide
DTLIA

SEQ ID NO: 571 - protein, 5 aa, Artificial Sequence
  Description of Artificial Sequence: Synthetic peptide
DTLTE

SEQ ID NO: 572 - protein, 5 aa, Artificial Sequence
  Description of Artificial Sequence: Synthetic peptide
GTLNH

SEQ ID NO: 573 - protein, 5 aa, Artificial Sequence
  Description of Artificial Sequence: Synthetic peptide
STLAI

SEQ ID NO: 574 - protein, 5 aa, Artificial Sequence
  Description of Artificial Sequence: Synthetic peptide
DQLVQ

SEQ ID NO: 575 - protein, 5 aa, Artificial Sequence
  Description of Artificial Sequence: Synthetic peptide
MPLIL

SEQ ID NO: 576 - protein, 5 aa, Artificial Sequence
  Description of Artificial Sequence: Synthetic peptide
TTLHQ

SEQ ID NO: 577 - protein, 5 aa, Artificial Sequence
  Description of Artificial Sequence: Synthetic peptide
TTLQV

SEQ ID NO: 578 - protein, 5 aa, Artificial Sequence
  Description of Artificial Sequence: Synthetic peptide
ATLLE

SEQ ID NO: 579 - protein, 5 aa, Artificial Sequence
  Description of Artificial Sequence: Synthetic peptide
DVLHE

SEQ ID NO: 580 - protein, 5 aa, Artificial Sequence
  Description of Artificial Sequence: Synthetic peptide
ETLRA

SEQ ID NO: 581 - protein, 5 aa, Artificial Sequence
  Description of Artificial Sequence: Synthetic peptide
KVLRS

SEQ ID NO: 582 - protein, 5 aa, Artificial Sequence
  Description of Artificial Sequence: Synthetic peptide
DSLRQ

SEQ ID NO: 583 - protein, 5 aa, Artificial Sequence
  Description of Artificial Sequence: Synthetic peptide
DTLAN

SEQ ID NO: 584 - protein, 5 aa, Artificial Sequence
  Description of Artificial Sequence: Synthetic peptide
GTLNV

SEQ ID NO: 585 - protein, 5 aa, Artificial Sequence
  Description of Artificial Sequence: Synthetic peptide
HNLMV

SEQ ID NO: 586 - protein, 5 aa, Artificial Sequence
  Description of Artificial Sequence: Synthetic peptide
QTLQA

SEQ ID NO: 587 - protein, 5 aa, Artificial Sequence
  Description of Artificial Sequence: Synthetic peptide
RQLTT

SEQ ID NO: 588 - protein, 5 aa, Artificial Sequence
  Description of Artificial Sequence: Synthetic peptide
DTLSI

SEQ ID NO: 589 - protein, 5 aa, Artificial Sequence
  Description of Artificial Sequence: Synthetic peptide
DRLVG

SEQ ID NO: 590 - protein, 5 aa, Artificial Sequence
  Description of Artificial Sequence: Synthetic peptide
ETLRQ

SEQ ID NO: 591 - protein, 5 aa, Artificial Sequence
  Description of Artificial Sequence: Synthetic peptide
SSLGE

SEQ ID NO: 592 - protein, 5 aa, Artificial Sequence
  Description of Artificial Sequence: Synthetic peptide
SSLVV

SEQ ID NO: 593 - protein, 5 aa, Artificial Sequence
  Description of Artificial Sequence: Synthetic peptide
DTLME

SEQ ID NO: 594 - protein, 5 aa, Artificial Sequence
  Description of Artificial Sequence: Synthetic peptide
DTLTV

SEQ ID NO: 595 - protein, 5 aa, Artificial Sequence
  Description of Artificial Sequence: Synthetic peptide
DTLVG

SEQ ID NO: 596 - protein, 5 aa, Artificial Sequence
  Description of Artificial Sequence: Synthetic peptide
ETLKA

SEQ ID NO: 597 - protein, 5 aa, Artificial Sequence
  Description of Artificial Sequence: Synthetic peptide
GVLSQ

SEQ ID NO: 598 - protein, 5 aa, Artificial Sequence
  Description of Artificial Sequence: Synthetic peptide
LALMR

SEQ ID NO: 599 - protein, 5 aa, Artificial Sequence
  Description of Artificial Sequence: Synthetic peptide
RTLVE

SEQ ID NO: 600 - protein, 5 aa, Artificial Sequence
  Description of Artificial Sequence: Synthetic peptide
TTLLI

SEQ ID NO: 601 - protein, 5 aa, Artificial Sequence
  Description of Artificial Sequence: Synthetic peptide
TTLNV

SEQ ID NO: 602 - protein, 5 aa, Artificial Sequence
  Description of Artificial Sequence: Synthetic peptide
DTLSE

SEQ ID NO: 603 - protein, 5 aa, Artificial Sequence
  Description of Artificial Sequence: Synthetic peptide
STLAV

SEQ ID NO: 604 - protein, 5 aa, Artificial Sequence
  Description of Artificial Sequence: Synthetic peptide
DNLRA

SEQ ID NO: 605 - protein, 5 aa, Artificial Sequence
  Description of Artificial Sequence: Synthetic peptide
DNLMV

SEQ ID NO: 606 - protein, 5 aa, Artificial Sequence
  Description of Artificial Sequence: Synthetic peptide
DNLQV

SEQ ID NO: 607 - protein, 5 aa, Artificial Sequence
  Description of Artificial Sequence: Synthetic peptide
DNLQQ

SEQ ID NO: 608 - protein, 5 aa, Artificial Sequence
  Description of Artificial Sequence: Synthetic peptide
DNLRQ

SEQ ID NO: 609 - protein, 5 aa, Artificial Sequence
  Description of Artificial Sequence: Synthetic peptide
DNLNT

SEQ ID NO: 610 - protein, 5 aa, Artificial Sequence
  Description of Artificial Sequence: Synthetic peptide
SNLVV

SEQ ID NO: 611 - protein, 5 aa, Artificial Sequence
  Description of Artificial Sequence: Synthetic peptide
SNLQQ

SEQ ID NO: 612 - protein, 5 aa, Artificial Sequence
  Description of Artificial Sequence: Synthetic peptide
DNLLS

SEQ ID NO: 613 - protein, 5 aa, Artificial Sequence
  Description of Artificial Sequence: Synthetic peptide
DNLTT

SEQ ID NO: 614 - protein, 5 aa, Artificial Sequence
  Description of Artificial Sequence: Synthetic peptide
DNLAA

SEQ ID NO: 615 - protein, 5 aa, Artificial Sequence
  Description of Artificial Sequence: Synthetic peptide
SNLLA

SEQ ID NO: 616 - protein, 5 aa, Artificial Sequence
  Description of Artificial Sequence: Synthetic peptide
SNLLQ

SEQ ID NO: 617 - protein, 5 aa, Artificial Sequence
  Description of Artificial Sequence: Synthetic peptide
SNLAV

SEQ ID NO: 618 - protein, 5 aa, Artificial Sequence
  Description of Artificial Sequence: Synthetic peptide
DNLNA

SEQ ID NO: 619 - protein, 5 aa, Artificial Sequence
  Description of Artificial Sequence: Synthetic peptide
DNLGT

SEQ ID NO: 620 - protein, 5 aa, Artificial Sequence
  Description of Artificial Sequence: Synthetic peptide
DNLKA

SEQ ID NO: 621 - protein, 5 aa, Artificial Sequence
  Description of Artificial Sequence: Synthetic peptide
DNLMQ

SEQ ID NO: 622 - protein, 5 aa, Artificial Sequence
  Description of Artificial Sequence: Synthetic peptide
DNLKV

SEQ ID NO: 623 - protein, 5 aa, Artificial Sequence
  Description of Artificial Sequence: Synthetic peptide
SNLNV

SEQ ID NO: 624 - protein, 5 aa, Artificial Sequence
  Description of Artificial Sequence: Synthetic peptide
SNLMA

SEQ ID NO: 625 - protein, 5 aa, Artificial Sequence
  Description of Artificial Sequence: Synthetic peptide
SVLQD

SEQ ID NO: 626 - protein, 5 aa, Artificial Sequence
  Description of Artificial Sequence: Synthetic peptide
DNLQS

SEQ ID NO: 627 - protein, 5 aa, Artificial Sequence
  Description of Artificial Sequence: Synthetic peptide
DNLSA

SEQ ID NO: 628 - protein, 5 aa, Artificial Sequence
  Description of Artificial Sequence: Synthetic peptide
DNLAQ

SEQ ID NO: 629 - protein, 5 aa, Artificial Sequence
  Description of Artificial Sequence: Synthetic peptide
DNLMS

SEQ ID NO: 630 - protein, 5 aa, Artificial Sequence
  Description of Artificial Sequence: Synthetic peptide
DNLSQ

SEQ ID NO: 631 - protein, 5 aa, Artificial Sequence
  Description of Artificial Sequence: Synthetic peptide
DNLNV

SEQ ID NO: 632 - protein, 5 aa, Artificial Sequence
  Description of Artificial Sequence: Synthetic peptide
DNLGV

SEQ ID NO: 633 - protein, 5 aa, Artificial Sequence
  Description of Artificial Sequence: Synthetic peptide
SNLLT

SEQ ID NO: 634 - protein, 5 aa, Artificial Sequence
  Description of Artificial Sequence: Synthetic peptide
DNLIA

SEQ ID NO: 635 - protein, 5 aa, Artificial Sequence
  Description of Artificial Sequence: Synthetic peptide
DNLNQ

SEQ ID NO: 636 - protein, 5 aa, Artificial Sequence
  Description of Artificial Sequence: Synthetic peptide
SNLQT

SEQ ID NO: 637 - protein, 5 aa, Artificial Sequence
  Description of Artificial Sequence: Synthetic peptide
SNLRV

SEQ ID NO: 638 - protein, 5 aa, Artificial Sequence
  Description of Artificial Sequence: Synthetic peptide
SNLIV

SEQ ID NO: 639 - protein, 5 aa, Artificial Sequence
  Description of Artificial Sequence: Synthetic peptide
DNLSV

SEQ ID NO: 640 - protein, 5 aa, Artificial Sequence
  Description of Artificial Sequence: Synthetic peptide
SNLQA

SEQ ID NO: 641 - protein, 5 aa, Artificial Sequence
  Description of Artificial Sequence: Synthetic peptide
SNLLL

SEQ ID NO: 642 - protein, 5 aa, Artificial Sequence
  Description of Artificial Sequence: Synthetic peptide
SNLDV

SEQ ID NO: 643 - protein, 5 aa, Artificial Sequence
  Description of Artificial Sequence: Synthetic peptide
DNLVQ

SEQ ID NO: 644 - protein, 5 aa, Artificial Sequence
  Description of Artificial Sequence: Synthetic peptide
SNLLI

SEQ ID NO: 645 - protein, 5 aa, Artificial Sequence
  Description of Artificial Sequence: Synthetic peptide
TGLAL

SEQ ID NO: 646 - protein, 5 aa, Artificial Sequence
  Description of Artificial Sequence: Synthetic peptide
SNLMQ

SEQ ID NO: 647 - protein, 5 aa, Artificial Sequence
  Description of Artificial Sequence: Synthetic peptide
DQLKI

SEQ ID NO: 648 - protein, 5 aa, Artificial Sequence
  Description of Artificial Sequence: Synthetic peptide
GDLGT

SEQ ID NO: 649 - protein, 5 aa, Artificial Sequence
  Description of Artificial Sequence: Synthetic peptide
SNLKV

SEQ ID NO: 650 - protein, 5 aa, Artificial Sequence
  Description of Artificial Sequence: Synthetic peptide
VPLVD

SEQ ID NO: 651 - protein, 5 aa, Artificial Sequence
  Description of Artificial Sequence: Synthetic peptide
DNLRI

SEQ ID NO: 652 - protein, 5 aa, Artificial Sequence
  Description of Artificial Sequence: Synthetic peptide
DNLLI

SEQ ID NO: 653 - protein, 5 aa, Artificial Sequence
  Description of Artificial Sequence: Synthetic peptide
TNLDV

SEQ ID NO: 654 - protein, 5 aa, Artificial Sequence
  Description of Artificial Sequence: Synthetic peptide
HDLKI

SEQ ID NO: 655 - protein, 5 aa, Artificial Sequence
  Description of Artificial Sequence: Synthetic peptide
DNLVV

SEQ ID NO: 656 - protein, 5 aa, Artificial Sequence
  Description of Artificial Sequence: Synthetic peptide
DNLTV

SEQ ID NO: 657 - protein, 5 aa, Artificial Sequence
  Description of Artificial Sequence: Synthetic peptide
DNLVT

SEQ ID NO: 658 - protein, 5 aa, Artificial Sequence
  Description of Artificial Sequence: Synthetic peptide
SNLAQ

SEQ ID NO: 659 - protein, 5 aa, Artificial Sequence
  Description of Artificial Sequence: Synthetic peptide
DNLIV

SEQ ID NO: 660 - protein, 5 aa, Artificial Sequence
  Description of Artificial Sequence: Synthetic peptide
SNLMT

SEQ ID NO: 661 - protein, 5 aa, Artificial Sequence
  Description of Artificial Sequence: Synthetic peptide
SNLTQ

SEQ ID NO: 662 - protein, 5 aa, Artificial Sequence
  Description of Artificial Sequence: Synthetic peptide
EILRI

SEQ ID NO: 663 - protein, 5 aa, Artificial Sequence
  Description of Artificial Sequence: Synthetic peptide
IGLEA

SEQ ID NO: 664 - protein, 5 aa, Artificial Sequence
  Description of Artificial Sequence: Synthetic peptide
HRLGG

SEQ ID NO: 665 - protein, 5 aa, Artificial Sequence
  Description of Artificial Sequence: Synthetic peptide
DNLST

SEQ ID NO: 666 - protein, 5 aa, Artificial Sequence
  Description of Artificial Sequence: Synthetic peptide
MRLHV

SEQ ID NO: 667 - protein, 5 aa, Artificial Sequence
  Description of Artificial Sequence: Synthetic peptide
SNLTT

SEQ ID NO: 668 - protein, 5 aa, Artificial Sequence
  Description of Artificial Sequence: Synthetic peptide
SNLGV

SEQ ID NO: 669 - protein, 5 aa, Artificial Sequence
  Description of Artificial Sequence: Synthetic peptide
SNLAT

SEQ ID NO: 670 - protein, 5 aa, Artificial Sequence
  Description of Artificial Sequence: Synthetic peptide
ANLMV

SEQ ID NO: 671 - protein, 5 aa, Artificial Sequence
  Description of Artificial Sequence: Synthetic peptide
HVLVG

SEQ ID NO: 672 - protein, 5 aa, Artificial Sequence
  Description of Artificial Sequence: Synthetic peptide
SNLRA

SEQ ID NO: 673 - protein, 5 aa, Artificial Sequence
  Description of Artificial Sequence: Synthetic peptide
HNLQL

SEQ ID NO: 674 - protein, 5 aa, Artificial Sequence
  Description of Artificial Sequence: Synthetic peptide
DNLVA

SEQ ID NO: 675 - protein, 5 aa, Artificial Sequence
  Description of Artificial Sequence: Synthetic peptide
SNLTA

SEQ ID NO: 676 - protein, 5 aa, Artificial Sequence
  Description of Artificial Sequence: Synthetic peptide
KGLRM

SEQ ID NO: 677 - protein, 5 aa, Artificial Sequence
  Description of Artificial Sequence: Synthetic peptide
PMLGV

SEQ ID NO: 678 - protein, 5 aa, Artificial Sequence
  Description of Artificial Sequence: Synthetic peptide
GVLVA

SEQ ID NO: 679 - protein, 5 aa, Artificial Sequence
  Description of Artificial Sequence: Synthetic peptide
DNLQD

SEQ ID NO: 680 - protein, 5 aa, Artificial Sequence
  Description of Artificial Sequence: Synthetic peptide
MKLGT

SEQ ID NO: 681 - protein, 4 aa, Artificial Sequence
  Description of Artificial Sequence: Synthetic peptide
RRHD

SEQ ID NO: 682 - protein, 4 aa, Artificial Sequence
  Description of Artificial Sequence: Synthetic peptide
RKTD

SEQ ID NO: 683 - protein, 4 aa, Artificial Sequence
  Description of Artificial Sequence: Synthetic peptide
NVSM

SEQ ID NO: 684 - protein, 4 aa, Artificial Sequence
  Description of Artificial Sequence: Synthetic peptide
RQSD

SEQ ID NO: 685 - protein, 4 aa, Artificial Sequence
  Description of Artificial Sequence: Synthetic peptide
RKND

SEQ ID NO: 686 - protein, 4 aa, Artificial Sequence
  Description of Artificial Sequence: Synthetic peptide
SENV

SEQ ID NO: 687 - protein, 4 aa, Artificial Sequence
  Description of Artificial Sequence: Synthetic peptide
VDHR

SEQ ID NO: 688 - protein, 4 aa, Artificial Sequence
  Description of Artificial Sequence: Synthetic peptide
AQIV

SEQ ID NO: 689 - protein, 4 aa, Artificial Sequence
  Description of Artificial Sequence: Synthetic peptide
KTPH

SEQ ID NO: 690 - protein, 4 aa, Artificial Sequence
  Description of Artificial Sequence: Synthetic peptide
PKIV

SEQ ID NO: 691 - protein, 4 aa, Artificial Sequence
  Description of Artificial Sequence: Synthetic peptide
GAEP

SEQ ID NO: 692 - protein, 4 aa, Artificial Sequence
  Description of Artificial Sequence: Synthetic peptide
MLVE

SEQ ID NO: 693 - protein, 4 aa, Artificial Sequence
  Description of Artificial Sequence: Synthetic peptide
VVGN

SEQ ID NO: 694 - protein, 4 aa, Artificial Sequence
  Description of Artificial Sequence: Synthetic peptide
KGPE

SEQ ID NO: 695 - protein, 4 aa, Artificial Sequence
  Description of Artificial Sequence: Synthetic peptide
GKVM

SEQ ID NO: 696 - protein, 4 aa, Artificial Sequence
  Description of Artificial Sequence: Synthetic peptide
TEPG

SEQ ID NO: 697 - protein, 4 aa, Artificial Sequence
  Description of Artificial Sequence: Synthetic peptide
TPHN

SEQ ID NO: 698 - protein, 4 aa, Artificial Sequence
  Description of Artificial Sequence: Synthetic peptide
MPGG

SEQ ID NO: 699 - protein, 4 aa, Artificial Sequence
  Description of Artificial Sequence: Synthetic peptide
DLEK

SEQ ID NO: 700 - protein, 4 aa, Artificial Sequence
  Description of Artificial Sequence: Synthetic peptide
GTDN

SEQ ID NO: 701 - protein, 4 aa, Artificial Sequence
  Description of Artificial Sequence: Synthetic peptide
ISRL

SEQ ID NO: 702 - protein, 4 aa, Artificial Sequence
  Description of Artificial Sequence: Synthetic peptide
ATGL

SEQ ID NO: 703 - protein, 4 aa, Artificial Sequence
  Description of Artificial Sequence: Synthetic peptide
ASNP

SEQ ID NO: 704 - protein, 4 aa, Artificial Sequence
  Description of Artificial Sequence: Synthetic peptide
GAPT

SEQ ID NO: 705 - protein, 4 aa, Artificial Sequence
  Description of Artificial Sequence: Synthetic peptide
HSPN

SEQ ID NO: 706 - protein, 4 aa, Artificial Sequence
  Description of Artificial Sequence: Synthetic peptide
RPVA

SEQ ID NO: 707 - protein, 4 aa, Artificial Sequence
  Description of Artificial Sequence: Synthetic peptide
MLVD

SEQ ID NO: 708 - protein, 4 aa, Artificial Sequence
  Description of Artificial Sequence: Synthetic peptide
RHRK

SEQ ID NO: 709 - protein, 4 aa, Artificial Sequence
  Description of Artificial Sequence: Synthetic peptide
RKHV

SEQ ID NO: 710 - protein, 4 aa, Artificial Sequence
  Description of Artificial Sequence: Synthetic peptide
RKQD

SEQ ID NO: 711 - protein, 4 aa, Artificial Sequence
  Description of Artificial Sequence: Synthetic peptide
RKSD

SEQ ID NO: 712 - protein, 4 aa, Artificial Sequence
  Description of Artificial Sequence: Synthetic peptide
DHHT

SEQ ID NO: 713 - protein, 4 aa, Artificial Sequence
  Description of Artificial Sequence: Synthetic peptide
GKHD

SEQ ID NO: 714 - protein, 4 aa, Artificial Sequence
  Description of Artificial Sequence: Synthetic peptide
MKAD

SEQ ID NO: 715 - protein, 4 aa, Artificial Sequence
  Description of Artificial Sequence: Synthetic peptide
RKAE

SEQ ID NO: 716 - protein, 4 aa, Artificial Sequence
  Description of Artificial Sequence: Synthetic peptide
RRAD

SEQ ID NO: 717 - protein, 4 aa, Artificial Sequence
  Description of Artificial Sequence: Synthetic peptide
APIG

SEQ ID NO: 718 - protein, 4 aa, Artificial Sequence
  Description of Artificial Sequence: Synthetic peptide
AQNR

SEQ ID NO: 719 - protein, 4 aa, Artificial Sequence
  Description of Artificial Sequence: Synthetic peptide
DMDA

SEQ ID NO: 720 - protein, 4 aa, Artificial Sequence
  Description of Artificial Sequence: Synthetic peptide
EAPM

SEQ ID NO: 721 - protein, 4 aa, Artificial Sequence
  Description of Artificial Sequence: Synthetic peptide
EEMM

SEQ ID NO: 722 - protein, 4 aa, Artificial Sequence
  Description of Artificial Sequence: Synthetic peptide
EPIR

SEQ ID NO: 723 - protein, 4 aa, Artificial Sequence
  Description of Artificial Sequence: Synthetic peptide
GALE

SEQ ID NO: 724 - protein, 4 aa, Artificial Sequence
  Description of Artificial Sequence: Synthetic peptide
GENV

SEQ ID NO: 725 - protein, 4 aa, Artificial Sequence
  Description of Artificial Sequence: Synthetic peptide
GKAD

SEQ ID NO: 726 - protein, 4 aa, Artificial Sequence
  Description of Artificial Sequence: Synthetic peptide
GKVD

SEQ ID NO: 727 - protein, 4 aa, Artificial Sequence
  Description of Artificial Sequence: Synthetic peptide
GPLA

SEQ ID NO: 728 - protein, 4 aa, Artificial Sequence
  Description of Artificial Sequence: Synthetic peptide
GRIE

SEQ ID NO: 729 - protein, 4 aa, Artificial Sequence
  Description of Artificial Sequence: Synthetic peptide
IEKL

SEQ ID NO: 730 - protein, 4 aa, Artificial Sequence
  Description of Artificial Sequence: Synthetic peptide
KAAS

SEQ ID NO: 731 - protein, 4 aa, Artificial Sequence
  Description of Artificial Sequence: Synthetic peptide
KEEH

SEQ ID NO: 732 - protein, 4 aa, Artificial Sequence
  Description of Artificial Sequence: Synthetic peptide
LKVD

SEQ ID NO: 733 - protein, 4 aa, Artificial Sequence
  Description of Artificial Sequence: Synthetic peptide
LLVE

SEQ ID NO: 734 - protein, 4 aa, Artificial Sequence
  Description of Artificial Sequence: Synthetic peptide
LMTQ

SEQ ID NO: 735 - protein, 4 aa, Artificial Sequence
  Description of Artificial Sequence: Synthetic peptide
MASL

SEQ ID NO: 736 - protein, 4 aa, Artificial Sequence
  Description of Artificial Sequence: Synthetic peptide
MGIG

SEQ ID NO: 737 - protein, 4 aa, Artificial Sequence
  Description of Artificial Sequence: Synthetic peptide
MPGD

SEQ ID NO: 738 - protein, 4 aa, Artificial Sequence
  Description of Artificial Sequence: Synthetic peptide
MSLG

SEQ ID NO: 739 - protein, 4 aa, Artificial Sequence
  Description of Artificial Sequence: Synthetic peptide
NDMT

SEQ ID NO: 740 - protein, 4 aa, Artificial Sequence
  Description of Artificial Sequence: Synthetic peptide
NMHT

SEQ ID NO: 741 - protein, 4 aa, Artificial Sequence
  Description of Artificial Sequence: Synthetic peptide
NRIV

SEQ ID NO: 742 - protein, 4 aa, Artificial Sequence
  Description of Artificial Sequence: Synthetic peptide
PENA

SEQ ID NO: 743 - protein, 4 aa, Artificial Sequence
  Description of Artificial Sequence: Synthetic peptide
QKHD

SEQ ID NO: 744 - protein, 4 aa, Artificial Sequence
  Description of Artificial Sequence: Synthetic peptide
QVPD

SEQ ID NO: 745 - protein, 4 aa, Artificial Sequence
  Description of Artificial Sequence: Synthetic peptide
RASD

SEQ ID NO: 746 - protein, 4 aa, Artificial Sequence
  Description of Artificial Sequence: Synthetic peptide
REHD

SEQ ID NO: 747 - protein, 4 aa, Artificial Sequence
  Description of Artificial Sequence: Synthetic peptide
RGHD

SEQ ID NO: 748 - protein, 4 aa, Artificial Sequence
  Description of Artificial Sequence: Synthetic peptide
RKHA

SEQ ID NO: 749 - protein, 4 aa, Artificial Sequence
  Description of Artificial Sequence: Synthetic peptide
RKHY

SEQ ID NO: 750 - protein, 4 aa, Artificial Sequence
  Description of Artificial Sequence: Synthetic peptide
RKLD

SEQ ID NO: 751 - protein, 4 aa, Artificial Sequence
  Description of Artificial Sequence: Synthetic peptide
RKPD

SEQ ID NO: 752 - protein, 4 aa, Artificial Sequence
  Description of Artificial Sequence: Synthetic peptide
RKVD

SEQ ID NO: 753 - protein, 4 aa, Artificial Sequence
  Description of Artificial Sequence: Synthetic peptide
RKYD

SEQ ID NO: 754 - protein, 4 aa, Artificial Sequence
  Description of Artificial Sequence: Synthetic peptide
RMSD

SEQ ID NO: 755 - protein, 4 aa, Artificial Sequence
  Description of Artificial Sequence: Synthetic peptide
RRLD

SEQ ID NO: 756 - protein, 4 aa, Artificial Sequence
  Description of Artificial Sequence: Synthetic peptide
RRND

SEQ ID NO: 757 - protein, 4 aa, Artificial Sequence
  Description of Artificial Sequence: Synthetic peptide
RRRD

SEQ ID NO: 758 - protein, 4 aa, Artificial Sequence
  Description of Artificial Sequence: Synthetic peptide
RRSG

SEQ ID NO: 759 - protein, 4 aa, Artificial Sequence
  Description of Artificial Sequence: Synthetic peptide
RWHD

SEQ ID NO: 760 - protein, 4 aa, Artificial Sequence
  Description of Artificial Sequence: Synthetic peptide
SHRL

SEQ ID NO: 761 - protein, 4 aa, Artificial Sequence
  Description of Artificial Sequence: Synthetic peptide
SQHV

SEQ ID NO: 762 - protein, 4 aa, Artificial Sequence
  Description of Artificial Sequence: Synthetic peptide
SSHD

SEQ ID NO: 763 - protein, 4 aa, Artificial Sequence
  Description of Artificial Sequence: Synthetic peptide
TTHV

SEQ ID NO: 764 - protein, 4 aa, Artificial Sequence
  Description of Artificial Sequence: Synthetic peptide
VHHV

SEQ ID NO: 765 - protein, 4 aa, Artificial Sequence
  Description of Artificial Sequence: Synthetic peptide
WKAD

SEQ ID NO: 766 - protein, 4 aa, Artificial Sequence
  Description of Artificial Sequence: Synthetic peptide
WKHD

SEQ ID NO: 767 - protein, 4 aa, Artificial Sequence
  Description of Artificial Sequence: Synthetic peptide
HADA

SEQ ID NO: 768 - protein, 4 aa, Artificial Sequence
  Description of Artificial Sequence: Synthetic peptide
RKWD

SEQ ID NO: 769 - protein, 4 aa, Artificial Sequence
  Description of Artificial Sequence: Synthetic peptide
RKGD

SEQ ID NO: 770 - protein, 4 aa, Artificial Sequence
  Description of Artificial Sequence: Synthetic peptide
RRCD

SEQ ID NO: 771 - protein, 4 aa, Artificial Sequence
  Description of Artificial Sequence: Synthetic peptide
MLPA

SEQ ID NO: 772 - protein, 4 aa, Artificial Sequence
  Description of Artificial Sequence: Synthetic peptide
RATD

SEQ ID NO: 773 - protein, 4 aa, Artificial Sequence
  Description of Artificial Sequence: Synthetic peptide
RKDV

SEQ ID NO: 774 - protein, 4 aa, Artificial Sequence
  Description of Artificial Sequence: Synthetic peptide
KKPV

SEQ ID NO: 775 - protein, 4 aa, Artificial Sequence
  Description of Artificial Sequence: Synthetic peptide
GEHG

SEQ ID NO: 776 - protein, 4 aa, Artificial Sequence
  Description of Artificial Sequence: Synthetic peptide
HPVR

SEQ ID NO: 777 - protein, 4 aa, Artificial Sequence
  Description of Artificial Sequence: Synthetic peptide
RQHD

SEQ ID NO: 778 - protein, 4 aa, Artificial Sequence
  Description of Artificial Sequence: Synthetic peptide
RMMQ

SEQ ID NO: 779 - protein, 4 aa, Artificial Sequence
  Description of Artificial Sequence: Synthetic peptide
RRGD

SEQ ID NO: 780 - protein, 4 aa, Artificial Sequence
  Description of Artificial Sequence: Synthetic peptide
GREV

SEQ ID NO: 781 - protein, 4 aa, Artificial Sequence
  Description of Artificial Sequence: Synthetic peptide
REQD

SEQ ID NO: 782 - protein, 4 aa, Artificial Sequence
  Description of Artificial Sequence: Synthetic peptide
DRDM

SEQ ID NO: 783 - protein, 4 aa, Artificial Sequence
  Description of Artificial Sequence: Synthetic peptide
SKHD

SEQ ID NO: 784 - protein, 4 aa, Artificial Sequence
  Description of Artificial Sequence: Synthetic peptide
RLSD

SEQ ID NO: 785 - protein, 4 aa, Artificial Sequence
  Description of Artificial Sequence: Synthetic peptide
VPTV

SEQ ID NO: 786 - protein, 4 aa, Artificial Sequence
  Description of Artificial Sequence: Synthetic peptide
HKWD

SEQ ID NO: 787 - protein, 4 aa, Artificial Sequence
  Description of Artificial Sequence: Synthetic peptide
KKND

SEQ ID NO: 788 - protein, 4 aa, Artificial Sequence
  Description of Artificial Sequence: Synthetic peptide
RRSE

SEQ ID NO: 789 - protein, 4 aa, Artificial Sequence
  Description of Artificial Sequence: Synthetic peptide
READ

SEQ ID NO: 790 - protein, 4 aa, Artificial Sequence
  Description of Artificial Sequence: Synthetic peptide
RNTD

SEQ ID NO: 791 - protein, 4 aa, Artificial Sequence
  Description of Artificial Sequence: Synthetic peptide
MVRA

SEQ ID NO: 792 - protein, 4 aa, Artificial Sequence
  Description of Artificial Sequence: Synthetic peptide
RKED

SEQ ID NO: 793 - protein, 4 aa, Artificial Sequence
  Description of Artificial Sequence: Synthetic peptide
KTMG

SEQ ID NO: 794 - protein, 4 aa, Artificial Sequence
  Description of Artificial Sequence: Synthetic peptide
NEPN

SEQ ID NO: 795 - protein, 4 aa, Artificial Sequence
  Description of Artificial Sequence: Synthetic peptide
RGSD

SEQ ID NO: 796 - protein, 4 aa, Artificial Sequence
  Description of Artificial Sequence: Synthetic peptide
RKRD

SEQ ID NO: 797 - protein, 4 aa, Artificial Sequence
  Description of Artificial Sequence: Synthetic peptide
RWSD

SEQ ID NO: 798 - protein, 4 aa, Artificial Sequence
  Description of Artificial Sequence: Synthetic peptide
TPLP

SEQ ID NO: 799 - protein, 4 aa, Artificial Sequence
  Description of Artificial Sequence: Synthetic peptide
RKAN

SEQ ID NO: 800 - protein, 4 aa, Artificial Sequence
  Description of Artificial Sequence: Synthetic peptide
RKAY

SEQ ID NO: 801 - protein, 4 aa, Artificial Sequence
  Description of Artificial Sequence: Synthetic peptide
QLPL

SEQ ID NO: 802 - protein, 4 aa, Artificial Sequence
  Description of Artificial Sequence: Synthetic peptide
QGTS

SEQ ID NO: 803 - protein, 4 aa, Artificial Sequence
  Description of Artificial Sequence: Synthetic peptide
DTMV

SEQ ID NO: 804 - protein, 4 aa, Artificial Sequence
  Description of Artificial Sequence: Synthetic peptide
LKWD

SEQ ID NO: 805 - protein, 4 aa, Artificial Sequence
  Description of Artificial Sequence: Synthetic peptide
MNTL

SEQ ID NO: 806 - protein, 4 aa, Artificial Sequence
  Description of Artificial Sequence: Synthetic peptide
HADV

SEQ ID NO: 807 - protein, 4 aa, Artificial Sequence
  Description of Artificial Sequence: Synthetic peptide
GRAH

SEQ ID NO: 808 - protein, 4 aa, Artificial Sequence
  Description of Artificial Sequence: Synthetic peptide
MKHD

SEQ ID NO: 809 - protein, 4 aa, Artificial Sequence
  Description of Artificial Sequence: Synthetic peptide
HEDA

SEQ ID NO: 810 - protein, 4 aa, Artificial Sequence
  Description of Artificial Sequence: Synthetic peptide
RMLS

SEQ ID NO: 811 - protein, 4 aa, Artificial Sequence
  Description of Artificial Sequence: Synthetic peptide
WRSD

SEQ ID NO: 812 - protein, 4 aa, Artificial Sequence
  Description of Artificial Sequence: Synthetic peptide
DDAT

SEQ ID NO: 813 - protein, 4 aa, Artificial Sequence
  Description of Artificial Sequence: Synthetic peptide
DTEN

SEQ ID NO: 814 - protein, 4 aa, Artificial Sequence
  Description of Artificial Sequence: Synthetic peptide
STKN

SEQ ID NO: 815 - protein, 4 aa, Artificial Sequence
  Description of Artificial Sequence: Synthetic peptide
NIEI

SEQ ID NO: 816 - protein, 4 aa, Artificial Sequence
  Description of Artificial Sequence: Synthetic peptide
MVIN

SEQ ID NO: 817 - protein, 4 aa, Artificial Sequence
  Description of Artificial Sequence: Synthetic peptide
VPDT

SEQ ID NO: 818 - protein, 4 aa, Artificial Sequence
  Description of Artificial Sequence: Synthetic peptide
NIVP

SEQ ID NO: 819 - protein, 4 aa, Artificial Sequence
  Description of Artificial Sequence: Synthetic peptide
MVPS

SEQ ID NO: 820 - protein, 4 aa, Artificial Sequence
  Description of Artificial Sequence: Synthetic peptide
PNHP

SEQ ID NO: 821 - protein, 4 aa, Artificial Sequence
  Description of Artificial Sequence: Synthetic peptide
KTDV

SEQ ID NO: 822 - protein, 4 aa, Artificial Sequence
  Description of Artificial Sequence: Synthetic peptide
HIKM

SEQ ID NO: 823 - protein, 4 aa, Artificial Sequence
  Description of Artificial Sequence: Synthetic peptide
ILQI

SEQ ID NO: 824 - protein, 4 aa, Artificial Sequence
  Description of Artificial Sequence: Synthetic peptide
IVMQ

SEQ ID NO: 825 - protein, 4 aa, Artificial Sequence
  Description of Artificial Sequence: Synthetic peptide
QTNS

SEQ ID NO: 826 - protein, 4 aa, Artificial Sequence
  Description of Artificial Sequence: Synthetic peptide
ENMD

SEQ ID NO: 827 - protein, 4 aa, Artificial Sequence
  Description of Artificial Sequence: Synthetic peptide
TVER

SEQ ID NO: 828 - protein, 4 aa, Artificial Sequence
  Description of Artificial Sequence: Synthetic peptide
THDR

SEQ ID NO: 829 - protein, 4 aa, Artificial Sequence
  Description of Artificial Sequence: Synthetic peptide
IRSP

SEQ ID NO: 830 - protein, 4 aa, Artificial Sequence
  Description of Artificial Sequence: Synthetic peptide
ARIA

SEQ ID NO: 831 - protein, 4 aa, Artificial Sequence
  Description of Artificial Sequence: Synthetic peptide
EELI

SEQ ID NO: 832 - protein, 4 aa, Artificial Sequence
  Description of Artificial Sequence: Synthetic peptide
KPLR

SEQ ID NO: 833 - protein, 4 aa, Artificial Sequence
  Description of Artificial Sequence: Synthetic peptide
NRLS

SEQ ID NO: 834 - protein, 4 aa, Artificial Sequence
  Description of Artificial Sequence: Synthetic peptide
PTLR

SEQ ID NO: 835 - protein, 4 aa, Artificial Sequence
  Description of Artificial Sequence: Synthetic peptide
MHIL

SEQ ID NO: 836 - protein, 4 aa, Artificial Sequence
  Description of Artificial Sequence: Synthetic peptide
GGGP

SEQ ID NO: 837 - protein, 4 aa, Artificial Sequence
  Description of Artificial Sequence: Synthetic peptide
MVEN

SEQ ID NO: 838 - protein, 4 aa, Artificial Sequence
  Description of Artificial Sequence: Synthetic peptide
IVAT

SEQ ID NO: 839 - protein, 4 aa, Artificial Sequence
  Description of Artificial Sequence: Synthetic peptide
TLDR

SEQ ID NO: 840 - protein, 4 aa, Artificial Sequence
  Description of Artificial Sequence: Synthetic peptide
MEPL

SEQ ID NO: 841 - protein, 4 aa, Artificial Sequence
  Description of Artificial Sequence: Synthetic peptide
DTGV

SEQ ID NO: 842 - protein, 4 aa, Artificial Sequence
  Description of Artificial Sequence: Synthetic peptide
TSRS

SEQ ID NO: 843 - protein, 4 aa, Artificial Sequence
  Description of Artificial Sequence: Synthetic peptide
VLSI

SEQ ID NO: 844 - protein, 4 aa, Artificial Sequence
  Description of Artificial Sequence: Synthetic peptide
STVQ

SEQ ID NO: 845 - protein, 4 aa, Artificial Sequence
  Description of Artificial Sequence: Synthetic peptide
GPAQ

SEQ ID NO: 846 - protein, 4 aa, Artificial Sequence
  Description of Artificial Sequence: Synthetic peptide
VEQP

SEQ ID NO: 847 - protein, 4 aa, Artificial Sequence
  Description of Artificial Sequence: Synthetic peptide
MTKK

SEQ ID NO: 848 - protein, 4 aa, Artificial Sequence
  Description of Artificial Sequence: Synthetic peptide
PLIM

SEQ ID NO: 849 - protein, 4 aa, Artificial Sequence
  Description of Artificial Sequence: Synthetic peptide
AMTV

SEQ ID NO: 850 - protein, 4 aa, Artificial Sequence
  Description of Artificial Sequence: Synthetic peptide
SPMR

SEQ ID NO: 851 - protein, 4 aa, Artificial Sequence
  Description of Artificial Sequence: Synthetic peptide
EPNV

SEQ ID NO: 852 - protein, 4 aa, Artificial Sequence
  Description of Artificial Sequence: Synthetic peptide
MQIN

SEQ ID NO: 853 - protein, 4 aa, Artificial Sequence
  Description of Artificial Sequence: Synthetic peptide
ALDE

SEQ ID NO: 854 - protein, 4 aa, Artificial Sequence
  Description of Artificial Sequence: Synthetic peptide
ALEH

SEQ ID NO: 855 - protein, 4 aa, Artificial Sequence
  Description of Artificial Sequence: Synthetic peptide
REKD

SEQ ID NO: 856 - protein, 4 aa, Artificial Sequence
  Description of Artificial Sequence: Synthetic peptide
ELLA

SEQ ID NO: 857 - protein, 4 aa, Artificial Sequence
  Description of Artificial Sequence: Synthetic peptide
GVAR

SEQ ID NO: 858 - protein, 4 aa, Artificial Sequence
  Description of Artificial Sequence: Synthetic peptide
VDTL

SEQ ID NO: 859 - protein, 4 aa, Artificial Sequence
  Description of Artificial Sequence: Synthetic peptide
GHEN

SEQ ID NO: 860 - protein, 4 aa, Artificial Sequence
  Description of Artificial Sequence: Synthetic peptide
ELES

SEQ ID NO: 861 - protein, 4 aa, Artificial Sequence
  Description of Artificial Sequence: Synthetic peptide
DPDT

SEQ ID NO: 862 - protein, 4 aa, Artificial Sequence
  Description of Artificial Sequence: Synthetic peptide
SLEL

SEQ ID NO: 863 - protein, 4 aa, Artificial Sequence
  Description of Artificial Sequence: Synthetic peptide
TMNV

SEQ ID NO: 864 - protein, 4 aa, Artificial Sequence
  Description of Artificial Sequence: Synthetic peptide
IQPV

SEQ ID NO: 865 - protein, 4 aa, Artificial Sequence
  Description of Artificial Sequence: Synthetic peptide
MLQE

SEQ ID NO: 866 - protein, 4 aa, Artificial Sequence
  Description of Artificial Sequence: Synthetic peptide
VMTV

SEQ ID NO: 867 - protein, 4 aa, Artificial Sequence
  Description of Artificial Sequence: Synthetic peptide
MVEE

SEQ ID NO: 868 - protein, 4 aa, Artificial Sequence
  Description of Artificial Sequence: Synthetic peptide
VARP

SEQ ID NO: 869 - protein, 4 aa, Artificial Sequence
  Description of Artificial Sequence: Synthetic peptide
KAIG

SEQ ID NO: 870 - protein, 4 aa, Artificial Sequence
  Description of Artificial Sequence: Synthetic peptide
DRSM

SEQ ID NO: 871 - protein, 4 aa, Artificial Sequence
  Description of Artificial Sequence: Synthetic peptide
KNSI

SEQ ID NO: 872 - protein, 4 aa, Artificial Sequence
  Description of Artificial Sequence: Synthetic peptide
DDVS

SEQ ID NO: 873 - protein, 4 aa, Artificial Sequence
  Description of Artificial Sequence: Synthetic peptide
KPQP

SEQ ID NO: 874 - protein, 4 aa, Artificial Sequence
  Description of Artificial Sequence: Synthetic peptide
PHVP

SEQ ID NO: 875 - protein, 4 aa, Artificial Sequence
  Description of Artificial Sequence: Synthetic peptide
DTLQ

SEQ ID NO: 876 - protein, 4 aa, Artificial Sequence
  Description of Artificial Sequence: Synthetic peptide
KLGT

SEQ ID NO: 877 - protein, 4 aa, Artificial Sequence
  Description of Artificial Sequence: Synthetic peptide
IDPH

SEQ ID NO: 878 - protein, 4 aa, Artificial Sequence
  Description of Artificial Sequence: Synthetic peptide
HPNT

SEQ ID NO: 879 - protein, 4 aa, Artificial Sequence
  Description of Artificial Sequence: Synthetic peptide
KSRG

SEQ ID NO: 880 - protein, 4 aa, Artificial Sequence
  Description of Artificial Sequence: Synthetic peptide
RQMA

SEQ ID NO: 881 - protein, 4 aa, Artificial Sequence
  Description of Artificial Sequence: Synthetic peptide
KKEN

SEQ ID NO: 882 - protein, 4 aa, Artificial Sequence
  Description of Artificial Sequence: Synthetic peptide
QVLD

SEQ ID NO: 883 - protein, 4 aa, Artificial Sequence
  Description of Artificial Sequence: Synthetic peptide
RRQM

SEQ ID NO: 884 - protein, 4 aa, Artificial Sequence
  Description of Artificial Sequence: Synthetic peptide
ILKN

SEQ ID NO: 885 - protein, 4 aa, Artificial Sequence
  Description of Artificial Sequence: Synthetic peptide
HQMK

SEQ ID NO: 886 - protein, 4 aa, Artificial Sequence
  Description of Artificial Sequence: Synthetic peptide
MDGG

SEQ ID NO: 887 - protein, 4 aa, Artificial Sequence
  Description of Artificial Sequence: Synthetic peptide
AAGS

SEQ ID NO: 888 - protein, 4 aa, Artificial Sequence
  Description of Artificial Sequence: Synthetic peptide
STVV

SEQ ID NO: 889 - protein, 4 aa, Artificial Sequence
  Description of Artificial Sequence: Synthetic peptide
PARA

SEQ ID NO: 890 - protein, 4 aa, Artificial Sequence
  Description of Artificial Sequence: Synthetic peptide
ALQG

SEQ ID NO: 891 - protein, 4 aa, Artificial Sequence
  Description of Artificial Sequence: Synthetic peptide
SAPG

SEQ ID NO: 892 - protein, 4 aa, Artificial Sequence
  Description of Artificial Sequence: Synthetic peptide
PVLN

SEQ ID NO: 893 - protein, 4 aa, Artificial Sequence
  Description of Artificial Sequence: Synthetic peptide
TSLL

SEQ ID NO: 894 - protein, 4 aa, Artificial Sequence
  Description of Artificial Sequence: Synthetic peptide
HLDV

SEQ ID NO: 895 - protein, 4 aa, Artificial Sequence
  Description of Artificial Sequence: Synthetic peptide
IHIR

SEQ ID NO: 896 - protein, 4 aa, Artificial Sequence
  Description of Artificial Sequence: Synthetic peptide
SVTL

SEQ ID NO: 897 - protein, 4 aa, Artificial Sequence
  Description of Artificial Sequence: Synthetic peptide
VKDR

SEQ ID NO: 898 - protein, 4 aa, Artificial Sequence
  Description of Artificial Sequence: Synthetic peptide
KMTI

SEQ ID NO: 899 - protein, 4 aa, Artificial Sequence
  Description of Artificial Sequence: Synthetic peptide
AGEM

SEQ ID NO: 900 - protein, 4 aa, Artificial Sequence
  Description of Artificial Sequence: Synthetic peptide
GDSE

SEQ ID NO: 901 - protein, 4 aa, Artificial Sequence
  Description of Artificial Sequence: Synthetic peptide
QPVK

SEQ ID NO: 902 - protein, 4 aa, Artificial Sequence
  Description of Artificial Sequence: Synthetic peptide
KVEA

SEQ ID NO: 903 - protein, 4 aa, Artificial Sequence
  Description of Artificial Sequence: Synthetic peptide
EQER

SEQ ID NO: 904 - protein, 4 aa, Artificial Sequence
  Description of Artificial Sequence: Synthetic peptide
GHHV

SEQ ID NO: 905 - protein, 4 aa, Artificial Sequence
  Description of Artificial Sequence: Synthetic peptide
GMHL

SEQ ID NO: 906 - protein, 4 aa, Artificial Sequence
  Description of Artificial Sequence: Synthetic peptide
RLRR

SEQ ID NO: 907 - protein, 4 aa, Artificial Sequence
  Description of Artificial Sequence: Synthetic peptide
ATIR

SEQ ID NO: 908 - protein, 4 aa, Artificial Sequence
  Description of Artificial Sequence: Synthetic peptide
RMDI

SEQ ID NO: 909 - protein, 4 aa, Artificial Sequence
  Description of Artificial Sequence: Synthetic peptide
SVIH

SEQ ID NO: 910 - protein, 4 aa, Artificial Sequence
  Description of Artificial Sequence: Synthetic peptide
MDIG

SEQ ID NO: 911 - protein, 4 aa, Artificial Sequence
  Description of Artificial Sequence: Synthetic peptide
LART

SEQ ID NO: 912 - protein, 4 aa, Artificial Sequence
  Description of Artificial Sequence: Synthetic peptide
RLMA

SEQ ID NO: 913 - protein, 4 aa, Artificial Sequence
  Description of Artificial Sequence: Synthetic peptide
RQPP

SEQ ID NO: 914 - protein, 4 aa, Artificial Sequence
  Description of Artificial Sequence: Synthetic peptide
MTMT

SEQ ID NO: 915 - protein, 4 aa, Artificial Sequence
  Description of Artificial Sequence: Synthetic peptide
EDTR

SEQ ID NO: 916 - protein, 4 aa, Artificial Sequence
  Description of Artificial Sequence: Synthetic peptide
MRGR

SEQ ID NO: 917 - protein, 4 aa, Artificial Sequence
  Description of Artificial Sequence: Synthetic peptide
ELHA

SEQ ID NO: 918 - protein, 4 aa, Artificial Sequence
  Description of Artificial Sequence: Synthetic peptide
TNGQ

SEQ ID NO: 919 - protein, 4 aa, Artificial Sequence
  Description of Artificial Sequence: Synthetic peptide
VNLT

SEQ ID NO: 920 - protein, 4 aa, Artificial Sequence
  Description of Artificial Sequence: Synthetic peptide
MHIR

SEQ ID NO: 921 - protein, 4 aa, Artificial Sequence
  Description of Artificial Sequence: Synthetic peptide
MLLQ

SEQ ID NO: 922 - protein, 4 aa, Artificial Sequence
  Description of Artificial Sequence: Synthetic peptide
GRGE

SEQ ID NO: 923 - protein, 4 aa, Artificial Sequence
  Description of Artificial Sequence: Synthetic peptide
NLRG

SEQ ID NO: 924 - protein, 4 aa, Artificial Sequence
  Description of Artificial Sequence: Synthetic peptide
HIML

SEQ ID NO: 925 - protein, 4 aa, Artificial Sequence
  Description of Artificial Sequence: Synthetic peptide
MTSV

SEQ ID NO: 926 - protein, 4 aa, Artificial Sequence
  Description of Artificial Sequence: Synthetic peptide
RLSM

SEQ ID NO: 927 - protein, 4 aa, Artificial Sequence
  Description of Artificial Sequence: Synthetic peptide
DMGM

SEQ ID NO: 928 - protein, 4 aa, Artificial Sequence
  Description of Artificial Sequence: Synthetic peptide
MLMM

SEQ ID NO: 929 - protein, 4 aa, Artificial Sequence
  Description of Artificial Sequence: Synthetic peptide
LMEM

SEQ ID NO: 930 - protein, 4 aa, Artificial Sequence
  Description of Artificial Sequence: Synthetic peptide
QAVS

SEQ ID NO: 931 - protein, 4 aa, Artificial Sequence
  Description of Artificial Sequence: Synthetic peptide
SRVL

SEQ ID NO: 932 - protein, 4 aa, Artificial Sequence
  Description of Artificial Sequence: Synthetic peptide
DEDP

SEQ ID NO: 933 - protein, 4 aa, Artificial Sequence
  Description of Artificial Sequence: Synthetic peptide
SGDR

SEQ ID NO: 934 - protein, 4 aa, Artificial Sequence
  Description of Artificial Sequence: Synthetic peptide
MMNC

SEQ ID NO: 935 - protein, 4 aa, Artificial Sequence
  Description of Artificial Sequence: Synthetic peptide
NIGM

SEQ ID NO: 936 - protein, 4 aa, Artificial Sequence
  Description of Artificial Sequence: Synthetic peptide
MVQR

SEQ ID NO: 937 - protein, 4 aa, Artificial Sequence
  Description of Artificial Sequence: Synthetic peptide
APHR

SEQ ID NO: 938 - protein, 4 aa, Artificial Sequence
  Description of Artificial Sequence: Synthetic peptide
LDAG

SEQ ID NO: 939 - protein, 4 aa, Artificial Sequence
  Description of Artificial Sequence: Synthetic peptide
RLAN

SEQ ID NO: 940 - protein, 4 aa, Artificial Sequence
  Description of Artificial Sequence: Synthetic peptide
MKGS

SEQ ID NO: 941 - protein, 4 aa, Artificial Sequence
  Description of Artificial Sequence: Synthetic peptide
KKLV

SEQ ID NO: 942 - protein, 4 aa, Artificial Sequence
  Description of Artificial Sequence: Synthetic peptide
VNQE

SEQ ID NO: 943 - protein, 4 aa, Artificial Sequence
  Description of Artificial Sequence: Synthetic peptide
ILKQ

SEQ ID NO: 944 - protein, 4 aa, Artificial Sequence
  Description of Artificial Sequence: Synthetic peptide
PVIP

SEQ ID NO: 945 - protein, 4 aa, Artificial Sequence
  Description of Artificial Sequence: Synthetic peptide
VESL

SEQ ID NO: 946 - protein, 4 aa, Artificial Sequence
  Description of Artificial Sequence: Synthetic peptide
IKQN

SEQ ID NO: 947 - protein, 4 aa, Artificial Sequence
  Description of Artificial Sequence: Synthetic peptide
EDNI

SEQ ID NO: 948 - protein, 4 aa, Artificial Sequence
  Description of Artificial Sequence: Synthetic peptide
THRD

SEQ ID NO: 949 - protein, 4 aa, Artificial Sequence
  Description of Artificial Sequence: Synthetic peptide
IPAG

SEQ ID NO: 950 - protein, 4 aa, Artificial Sequence
  Description of Artificial Sequence: Synthetic peptide
GLNH

SEQ ID NO: 951 - protein, 4 aa, Artificial Sequence
  Description of Artificial Sequence: Synthetic peptide
VDGR

SEQ ID NO: 952 - protein, 4 aa, Artificial Sequence
  Description of Artificial Sequence: Synthetic peptide
RTGA

SEQ ID NO: 953 - protein, 4 aa, Artificial Sequence
  Description of Artificial Sequence: Synthetic peptide
VSPD

SEQ ID NO: 954 - protein, 4 aa, Artificial Sequence
  Description of Artificial Sequence: Synthetic peptide
KVGD

SEQ ID NO: 955 - protein, 5 aa, Artificial Sequence
  Description of Artificial Sequence: Synthetic peptide
GHMRR

SEQ ID NO: 956 - protein, 5 aa, Artificial Sequence
  Description of Artificial Sequence: Synthetic peptide
GHMNR

SEQ ID NO: 957 - protein, 5 aa, Artificial Sequence
  Description of Artificial Sequence: Synthetic peptide
THMRR

SEQ ID NO: 958 - protein, 5 aa, Artificial Sequence
  Description of Artificial Sequence: Synthetic peptide
GHMKR

SEQ ID NO: 959 - protein, 5 aa, Artificial Sequence
  Description of Artificial Sequence: Synthetic peptide
EHMQR

SEQ ID NO: 960 - protein, 5 aa, Artificial Sequence
  Description of Artificial Sequence: Synthetic peptide
SAMRR

SEQ ID NO: 961 - protein, 5 aa, Artificial Sequence
  Description of Artificial Sequence: Synthetic peptide
ENMGR

SEQ ID NO: 962 - protein, 5 aa, Artificial Sequence
  Description of Artificial Sequence: Synthetic peptide
SHMKR

SEQ ID NO: 963 - protein, 5 aa, Artificial Sequence
  Description of Artificial Sequence: Synthetic peptide
NHMRR

SEQ ID NO: 964 - protein, 5 aa, Artificial Sequence
  Description of Artificial Sequence: Synthetic peptide
EGMRR

SEQ ID NO: 965 - protein, 5 aa, Artificial Sequence
  Description of Artificial Sequence: Synthetic peptide
GNMGR

SEQ ID NO: 966 - protein, 5 aa, Artificial Sequence
  Description of Artificial Sequence: Synthetic peptide
NGMRI

SEQ ID NO: 967 - protein, 5 aa, Artificial Sequence
  Description of Artificial Sequence: Synthetic peptide
EGMAR

SEQ ID NO: 968 - protein, 5 aa, Artificial Sequence
  Description of Artificial Sequence: Synthetic peptide
ESMRR

SEQ ID NO: 969 - protein, 5 aa, Artificial Sequence
  Description of Artificial Sequence: Synthetic peptide
GHMSR

SEQ ID NO: 970 - protein, 5 aa, Artificial Sequence
  Description of Artificial Sequence: Synthetic peptide
EGMHR

SEQ ID NO: 971 - protein, 5 aa, Artificial Sequence
  Description of Artificial Sequence: Synthetic peptide
TAMRR

SEQ ID NO: 972 - protein, 5 aa, Artificial Sequence
  Description of Artificial Sequence: Synthetic peptide
TNMQR

SEQ ID NO: 973 - protein, 5 aa, Artificial Sequence
  Description of Artificial Sequence: Synthetic peptide
VNMRR

SEQ ID NO: 974 - protein, 5 aa, Artificial Sequence
  Description of Artificial Sequence: Synthetic peptide
AHMKR

SEQ ID NO: 975 - protein, 5 aa, Artificial Sequence
  Description of Artificial Sequence: Synthetic peptide
NGMTA

SEQ ID NO: 976 - protein, 5 aa, Artificial Sequence
  Description of Artificial Sequence: Synthetic peptide
DGMRR

SEQ ID NO: 977 - protein, 5 aa, Artificial Sequence
  Description of Artificial Sequence: Synthetic peptide
GHMTR

SEQ ID NO: 978 - protein, 5 aa, Artificial Sequence
  Description of Artificial Sequence: Synthetic peptide
EHMSR

SEQ ID NO: 979 - protein, 5 aa, Artificial Sequence
  Description of Artificial Sequence: Synthetic peptide
GSMRR

SEQ ID NO: 980 - protein, 5 aa, Artificial Sequence
  Description of Artificial Sequence: Synthetic peptide
TNMLR

SEQ ID NO: 981 - protein, 5 aa, Artificial Sequence
  Description of Artificial Sequence: Synthetic peptide
NHMKR

SEQ ID NO: 982 - protein, 5 aa, Artificial Sequence
  Description of Artificial Sequence: Synthetic peptide
ENMLR

SEQ ID NO: 983 - protein, 5 aa, Artificial Sequence
  Description of Artificial Sequence: Synthetic peptide
SPMGV

SEQ ID NO: 984 - protein, 5 aa, Artificial Sequence
  Description of Artificial Sequence: Synthetic peptide
TNMGR

SEQ ID NO: 985 - protein, 5 aa, Artificial Sequence
  Description of Artificial Sequence: Synthetic peptide
SSMAR

SEQ ID NO: 986 - protein, 5 aa, Artificial Sequence
  Description of Artificial Sequence: Synthetic peptide
GGMRR

SEQ ID NO: 987 - protein, 5 aa, Artificial Sequence
  Description of Artificial Sequence: Synthetic peptide
GGMKL

SEQ ID NO: 988 - protein, 5 aa, Artificial Sequence
  Description of Artificial Sequence: Synthetic peptide
SGMVR

SEQ ID NO: 989 - protein, 5 aa, Artificial Sequence
  Description of Artificial Sequence: Synthetic peptide
EHMHR

SEQ ID NO: 990 - protein, 5 aa, Artificial Sequence
  Description of Artificial Sequence: Synthetic peptide
THMSR

SEQ ID NO: 991 - protein, 5 aa, Artificial Sequence
  Description of Artificial Sequence: Synthetic peptide
GSMKI

SEQ ID NO: 992 - protein, 5 aa, Artificial Sequence
  Description of Artificial Sequence: Synthetic peptide
EKMKE

SEQ ID NO: 993 - protein, 5 aa, Artificial Sequence
  Description of Artificial Sequence: Synthetic peptide
NGMAR

SEQ ID NO: 994 - protein, 5 aa, Artificial Sequence
  Description of Artificial Sequence: Synthetic peptide
QNMVR

SEQ ID NO: 995 - protein, 5 aa, Artificial Sequence
  Description of Artificial Sequence: Synthetic peptide
DNMRR

SEQ ID NO: 996 - protein, 5 aa, Artificial Sequence
  Description of Artificial Sequence: Synthetic peptide
ENMER

SEQ ID NO: 997 - protein, 5 aa, Artificial Sequence
  Description of Artificial Sequence: Synthetic peptide
NSMRR

SEQ ID NO: 998 - protein, 5 aa, Artificial Sequence
  Description of Artificial Sequence: Synthetic peptide
SGMKR

SEQ ID NO: 999 - protein, 5 aa, Artificial Sequence
  Description of Artificial Sequence: Synthetic peptide
ANMQR

SEQ ID NO: 1000 - protein, 5 aa, Artificial Sequence
  Description of Artificial Sequence: Synthetic peptide
GHMQR

SEQ ID NO: 1001 - protein, 5 aa, Artificial Sequence
  Description of Artificial Sequence: Synthetic peptide
ANMGR

SEQ ID NO: 1002 - protein, 5 aa, Artificial Sequence
  Description of Artificial Sequence: Synthetic peptide
DNMVR

SEQ ID NO: 1003 - protein, 5 aa, Artificial Sequence
  Description of Artificial Sequence: Synthetic peptide
QAMRE

SEQ ID NO: 1004 - protein, 5 aa, Artificial Sequence
  Description of Artificial Sequence: Synthetic peptide
GNMSR

SEQ ID NO: 1005 - protein, 5 aa, Artificial Sequence
  Description of Artificial Sequence: Synthetic peptide
ESMQR

SEQ ID NO: 1006 - protein, 5 aa, Artificial Sequence
  Description of Artificial Sequence: Synthetic peptide
TPMKV

SEQ ID NO: 1007 - protein, 5 aa, Artificial Sequence
  Description of Artificial Sequence: Synthetic peptide
SNMGR

SEQ ID NO: 1008 - protein, 5 aa, Artificial Sequence
  Description of Artificial Sequence: Synthetic peptide
GAMRI

SEQ ID NO: 1009 - protein, 5 aa, Artificial Sequence
  Description of Artificial Sequence: Synthetic peptide
ANMNR

SEQ ID NO: 1010 - protein, 5 aa, Artificial Sequence
  Description of Artificial Sequence: Synthetic peptide
DNMMR

SEQ ID NO: 1011 - protein, 5 aa, Artificial Sequence
  Description of Artificial Sequence: Synthetic peptide
GSMKM

SEQ ID NO: 1012 - protein, 5 aa, Artificial Sequence
  Description of Artificial Sequence: Synthetic peptide
GNMAQ

SEQ ID NO: 1013 - protein, 5 aa, Artificial Sequence
  Description of Artificial Sequence: Synthetic peptide
EGMKG

SEQ ID NO: 1014 - protein, 5 aa, Artificial Sequence
  Description of Artificial Sequence: Synthetic peptide
SSMKI

SEQ ID NO: 1015 - protein, 5 aa, Artificial Sequence
  Description of Artificial Sequence: Synthetic peptide
TSMRR

SEQ ID NO: 1016 - protein, 5 aa, Artificial Sequence
  Description of Artificial Sequence: Synthetic peptide
DGMKR

SEQ ID NO: 1017 - protein, 5 aa, Artificial Sequence
  Description of Artificial Sequence: Synthetic peptide
DNMAR

SEQ ID NO: 1018 - protein, 5 aa, Artificial Sequence
  Description of Artificial Sequence: Synthetic peptide
SSMRR

SEQ ID NO: 1019 - protein, 5 aa, Artificial Sequence
  Description of Artificial Sequence: Synthetic peptide
GNMMR

SEQ ID NO: 1020 - protein, 5 aa, Artificial Sequence
  Description of Artificial Sequence: Synthetic peptide
THMKL

SEQ ID NO: 1021 - protein, 5 aa, Artificial Sequence
  Description of Artificial Sequence: Synthetic peptide
ENMAR

SEQ ID NO: 1022 - protein, 5 aa, Artificial Sequence
  Description of Artificial Sequence: Synthetic peptide
NNMVR

SEQ ID NO: 1023 - protein, 5 aa, Artificial Sequence
  Description of Artificial Sequence: Synthetic peptide
TGMKR

SEQ ID NO: 1024 - protein, 5 aa, Artificial Sequence
  Description of Artificial Sequence: Synthetic peptide
TAMKR

SEQ ID NO: 1025 - protein, 5 aa, Artificial Sequence
  Description of Artificial Sequence: Synthetic peptide
AHMNR

SEQ ID NO: 1026 - protein, 5 aa, Artificial Sequence
  Description of Artificial Sequence: Synthetic peptide
QNMGR

SEQ ID NO: 1027 - protein, 5 aa, Artificial Sequence
  Description of Artificial Sequence: Synthetic peptide
TNMVR

SEQ ID NO: 1028 - protein, 5 aa, Artificial Sequence
  Description of Artificial Sequence: Synthetic peptide
NHMNR

SEQ ID NO: 1029 - protein, 5 aa, Artificial Sequence
  Description of Artificial Sequence: Synthetic peptide
EHMTR

SEQ ID NO: 1030 - protein, 5 aa, Artificial Sequence
  Description of Artificial Sequence: Synthetic peptide
GNMIR

SEQ ID NO: 1031 - protein, 5 aa, Artificial Sequence
  Description of Artificial Sequence: Synthetic peptide
SGMRR

SEQ ID NO: 1032 - protein, 5 aa, Artificial Sequence
  Description of Artificial Sequence: Synthetic peptide
NHMSR

SEQ ID NO: 1033 - protein, 5 aa, Artificial Sequence
  Description of Artificial Sequence: Synthetic peptide
GGMRL

SEQ ID NO: 1034 - protein, 5 aa, Artificial Sequence
  Description of Artificial Sequence: Synthetic peptide
SPMKV

SEQ ID NO: 1035 - protein, 5 aa, Artificial Sequence
  Description of Artificial Sequence: Synthetic peptide
TNMRR

SEQ ID NO: 1036 - protein, 5 aa, Artificial Sequence
  Description of Artificial Sequence: Synthetic peptide
GNMRE

SEQ ID NO: 1037 - protein, 5 aa, Artificial Sequence
  Description of Artificial Sequence: Synthetic peptide
ENMMR

SEQ ID NO: 1038 - protein, 5 aa, Artificial Sequence
  Description of Artificial Sequence: Synthetic peptide
THMER

SEQ ID NO: 1039 - protein, 5 aa, Artificial Sequence
  Description of Artificial Sequence: Synthetic peptide
QKMRT

SEQ ID NO: 1040 - protein, 5 aa, Artificial Sequence
  Description of Artificial Sequence: Synthetic peptide
GAMRR

SEQ ID NO: 1041 - protein, 5 aa, Artificial Sequence
  Description of Artificial Sequence: Synthetic peptide
TPMEV

SEQ ID NO: 1042 - protein, 5 aa, Artificial Sequence
  Description of Artificial Sequence: Synthetic peptide
GGMRE

SEQ ID NO: 1043 - protein, 5 aa, Artificial Sequence
  Description of Artificial Sequence: Synthetic peptide
GDMDR

SEQ ID NO: 1044 - protein, 5 aa, Artificial Sequence
  Description of Artificial Sequence: Synthetic peptide
GAMRA

SEQ ID NO: 1045 - protein, 5 aa, Artificial Sequence
  Description of Artificial Sequence: Synthetic peptide
PNMSR

SEQ ID NO: 1046 - protein, 5 aa, Artificial Sequence
  Description of Artificial Sequence: Synthetic peptide
EGMGR

SEQ ID NO: 1047 - protein, 5 aa, Artificial Sequence
  Description of Artificial Sequence: Synthetic peptide
EGTHR

SEQ ID NO: 1048 - protein, 5 aa, Artificial Sequence
  Description of Artificial Sequence: Synthetic peptide
QSMRE

SEQ ID NO: 1049 - protein, 5 aa, Artificial Sequence
  Description of Artificial Sequence: Synthetic peptide
THMKG

SEQ ID NO: 1050 - protein, 5 aa, Artificial Sequence
  Description of Artificial Sequence: Synthetic peptide
NNMGR

SEQ ID NO: 1051 - protein, 5 aa, Artificial Sequence
  Description of Artificial Sequence: Synthetic peptide
GHMNS

SEQ ID NO: 1052 - protein, 5 aa, Artificial Sequence
  Description of Artificial Sequence: Synthetic peptide
IDMKG

SEQ ID NO: 1053 - protein, 5 aa, Artificial Sequence
  Description of Artificial Sequence: Synthetic peptide
ESMTR

SEQ ID NO: 1054 - protein, 5 aa, Artificial Sequence
  Description of Artificial Sequence: Synthetic peptide
SHMKI

SEQ ID NO: 1055 - protein, 5 aa, Artificial Sequence
  Description of Artificial Sequence: Synthetic peptide
HNMMR

SEQ ID NO: 1056 - protein, 5 aa, Artificial Sequence
  Description of Artificial Sequence: Synthetic peptide
TAMKV

SEQ ID NO: 1057 - protein, 5 aa, Artificial Sequence
  Description of Artificial Sequence: Synthetic peptide
DSMKR

SEQ ID NO: 1058 - protein, 5 aa, Artificial Sequence
  Description of Artificial Sequence: Synthetic peptide
SNMAR

SEQ ID NO: 1059 - protein, 5 aa, Artificial Sequence
  Description of Artificial Sequence: Synthetic peptide
ESMGR

SEQ ID NO: 1060 - protein, 5 aa, Artificial Sequence
  Description of Artificial Sequence: Synthetic peptide
EAMRR

SEQ ID NO: 1061 - protein, 5 aa, Artificial Sequence
  Description of Artificial Sequence: Synthetic peptide
GNMVR

SEQ ID NO: 1062 - protein, 5 aa, Artificial Sequence
  Description of Artificial Sequence: Synthetic peptide
ANMRR

SEQ ID NO: 1063 - protein, 5 aa, Artificial Sequence
  Description of Artificial Sequence: Synthetic peptide
DGMKI

SEQ ID NO: 1064 - protein, 5 aa, Artificial Sequence
  Description of Artificial Sequence: Synthetic peptide
SHMHR

SEQ ID NO: 1065 - protein, 5 aa, Artificial Sequence
  Description of Artificial Sequence: Synthetic peptide
GAMKE

SEQ ID NO: 1066 - protein, 5 aa, Artificial Sequence
  Description of Artificial Sequence: Synthetic peptide
ESMRE

SEQ ID NO: 1067 - protein, 5 aa, Artificial Sequence
  Description of Artificial Sequence: Synthetic peptide
GSMLR

SEQ ID NO: 1068 - protein, 5 aa, Artificial Sequence
  Description of Artificial Sequence: Synthetic peptide
THMEV

SEQ ID NO: 1069 - protein, 5 aa, Artificial Sequence
  Description of Artificial Sequence: Synthetic peptide
TSMGR

SEQ ID NO: 1070 - protein, 5 aa, Artificial Sequence
  Description of Artificial Sequence: Synthetic peptide
EAMSK

SEQ ID NO: 1071 - protein, 5 aa, Artificial Sequence
  Description of Artificial Sequence: Synthetic peptide
NAMRQ

SEQ ID NO: 1072 - protein, 5 aa, Artificial Sequence
  Description of Artificial Sequence: Synthetic peptide
EGMRT

SEQ ID NO: 1073 - protein, 5 aa, Artificial Sequence
  Description of Artificial Sequence: Synthetic peptide
SHMQR

SEQ ID NO: 1074 - protein, 5 aa, Artificial Sequence
  Description of Artificial Sequence: Synthetic peptide
NGMKR

SEQ ID NO: 1075 - protein, 5 aa, Artificial Sequence
  Description of Artificial Sequence: Synthetic peptide
ESMKE

SEQ ID NO: 1076 - protein, 5 aa, Artificial Sequence
  Description of Artificial Sequence: Synthetic peptide
ANMHR

SEQ ID NO: 1077 - protein, 5 aa, Artificial Sequence
  Description of Artificial Sequence: Synthetic peptide
DHTKR

SEQ ID NO: 1078 - protein, 5 aa, Artificial Sequence
  Description of Artificial Sequence: Synthetic peptide
NGMRE

SEQ ID NO: 1079 - protein, 5 aa, Artificial Sequence
  Description of Artificial Sequence: Synthetic peptide
GSMRA

SEQ ID NO: 1080 - protein, 5 aa, Artificial Sequence
  Description of Artificial Sequence: Synthetic peptide
EGMNQ

SEQ ID NO: 1081 - protein, 5 aa, Artificial Sequence
  Description of Artificial Sequence: Synthetic peptide
GGMRM

SEQ ID NO: 1082 - protein, 5 aa, Artificial Sequence
  Description of Artificial Sequence: Synthetic peptide
PNMKR

SEQ ID NO: 1083 - protein, 5 aa, Artificial Sequence
  Description of Artificial Sequence: Synthetic peptide
NGMKI

SEQ ID NO: 1084 - protein, 5 aa, Artificial Sequence
  Description of Artificial Sequence: Synthetic peptide
SNMLR

SEQ ID NO: 1085 - protein, 5 aa, Artificial Sequence
  Description of Artificial Sequence: Synthetic peptide
SNMRR

SEQ ID NO: 1086 - protein, 5 aa, Artificial Sequence
  Description of Artificial Sequence: Synthetic peptide
SHMTR

SEQ ID NO: 1087 - protein, 5 aa, Artificial Sequence
  Description of Artificial Sequence: Synthetic peptide
TGMRR

SEQ ID NO: 1088 - protein, 5 aa, Artificial Sequence
  Description of Artificial Sequence: Synthetic peptide
SGMRI

SEQ ID NO: 1089 - protein, 5 aa, Artificial Sequence
  Description of Artificial Sequence: Synthetic peptide
DNMGR

SEQ ID NO: 1090 - protein, 5 aa, Artificial Sequence
  Description of Artificial Sequence: Synthetic peptide
ETMRR

SEQ ID NO: 1091 - protein, 5 aa, Artificial Sequence
  Description of Artificial Sequence: Synthetic peptide
DNMKI

SEQ ID NO: 1092 - protein, 5 aa, Artificial Sequence
  Description of Artificial Sequence: Synthetic peptide
TNMER

SEQ ID NO: 1093 - protein, 5 aa, Artificial Sequence
  Description of Artificial Sequence: Synthetic peptide
TNMAR

SEQ ID NO: 1094 - protein, 5 aa, Artificial Sequence
  Description of Artificial Sequence: Synthetic peptide
EHMKQ

SEQ ID NO: 1095 - protein, 5 aa, Artificial Sequence
  Description of Artificial Sequence: Synthetic peptide
SGMQR

SEQ ID NO: 1096 - protein, 5 aa, Artificial Sequence
  Description of Artificial Sequence: Synthetic peptide
HNMRR

SEQ ID NO: 1097 - protein, 5 aa, Artificial Sequence
  Description of Artificial Sequence: Synthetic peptide
QNMER

SEQ ID NO: 1098 - protein, 5 aa, Artificial Sequence
  Description of Artificial Sequence: Synthetic peptide
VSMKR

SEQ ID NO: 1099 - protein, 5 aa, Artificial Sequence
  Description of Artificial Sequence: Synthetic peptide
TNMMR

SEQ ID NO: 1100 - protein, 5 aa, Artificial Sequence
  Description of Artificial Sequence: Synthetic peptide
GAMRM

SEQ ID NO: 1101 - protein, 5 aa, Artificial Sequence
  Description of Artificial Sequence: Synthetic peptide
TAMNQ

SEQ ID NO: 1102 - protein, 5 aa, Artificial Sequence
  Description of Artificial Sequence: Synthetic peptide
ESMSR

SEQ ID NO: 1103 - protein, 5 aa, Artificial Sequence
  Description of Artificial Sequence: Synthetic peptide
GGMNQ

SEQ ID NO: 1104 - protein, 5 aa, Artificial Sequence
  Description of Artificial Sequence: Synthetic peptide
GGMKR

SEQ ID NO: 1105 - protein, 5 aa, Artificial Sequence
  Description of Artificial Sequence: Synthetic peptide
ESMRL

SEQ ID NO: 1106 - protein, 5 aa, Artificial Sequence
  Description of Artificial Sequence: Synthetic peptide
SAMRE

SEQ ID NO: 1107 - protein, 5 aa, Artificial Sequence
  Description of Artificial Sequence: Synthetic peptide
GGMQM

SEQ ID NO: 1108 - protein, 5 aa, Artificial Sequence
  Description of Artificial Sequence: Synthetic peptide
NSMKM

SEQ ID NO: 1109 - protein, 5 aa, Artificial Sequence
  Description of Artificial Sequence: Synthetic peptide
ESMKN

SEQ ID NO: 1110 - protein, 5 aa, Artificial Sequence
  Description of Artificial Sequence: Synthetic peptide
TNMSR

SEQ ID NO: 1111 - protein, 5 aa, Artificial Sequence
  Description of Artificial Sequence: Synthetic peptide
DAMRV

SEQ ID NO: 1112 - protein, 5 aa, Artificial Sequence
  Description of Artificial Sequence: Synthetic peptide
GNMER

SEQ ID NO: 1113 - protein, 5 aa, Artificial Sequence
  Description of Artificial Sequence: Synthetic peptide
GAMRE

SEQ ID NO: 1114 - protein, 5 aa, Artificial Sequence
  Description of Artificial Sequence: Synthetic peptide
EGMRK

SEQ ID NO: 1115 - protein, 5 aa, Artificial Sequence
  Description of Artificial Sequence: Synthetic peptide
SGMAR

SEQ ID NO: 1116 - protein, 5 aa, Artificial Sequence
  Description of Artificial Sequence: Synthetic peptide
DHMKR

SEQ ID NO: 1117 - protein, 5 aa, Artificial Sequence
  Description of Artificial Sequence: Synthetic peptide
GHMHR

SEQ ID NO: 1118 - protein, 5 aa, Artificial Sequence
  Description of Artificial Sequence: Synthetic peptide
THMKV

SEQ ID NO: 1119 - protein, 5 aa, Artificial Sequence
  Description of Artificial Sequence: Synthetic peptide
DHMRR

SEQ ID NO: 1120 - protein, 5 aa, Artificial Sequence
  Description of Artificial Sequence: Synthetic peptide
AHMRR

SEQ ID NO: 1121 - protein, 5 aa, Artificial Sequence
  Description of Artificial Sequence: Synthetic peptide
EKMRE

SEQ ID NO: 1122 - protein, 5 aa, Artificial Sequence
  Description of Artificial Sequence: Synthetic peptide
GHMAR

SEQ ID NO: 1123 - protein, 5 aa, Artificial Sequence
  Description of Artificial Sequence: Synthetic peptide
VHMNR

SEQ ID NO: 1124 - protein, 5 aa, Artificial Sequence
  Description of Artificial Sequence: Synthetic peptide
NHMTR

SEQ ID NO: 1125 - protein, 5 aa, Artificial Sequence
  Description of Artificial Sequence: Synthetic peptide
THMTR

SEQ ID NO: 1126 - protein, 5 aa, Artificial Sequence
  Description of Artificial Sequence: Synthetic peptide
GHMKI

SEQ ID NO: 1127 - protein, 5 aa, Artificial Sequence
  Description of Artificial Sequence: Synthetic peptide
EHMVR

SEQ ID NO: 1128 - protein, 5 aa, Artificial Sequence
  Description of Artificial Sequence: Synthetic peptide
TKMKE

SEQ ID NO: 1129 - protein, 5 aa, Artificial Sequence
  Description of Artificial Sequence: Synthetic peptide
EHMER

SEQ ID NO: 1130 - protein, 5 aa, Artificial Sequence
  Description of Artificial Sequence: Synthetic peptide
THMKT

SEQ ID NO: 1131 - protein, 5 aa, Artificial Sequence
  Description of Artificial Sequence: Synthetic peptide
NGMRR

SEQ ID NO: 1132 - protein, 5 aa, Artificial Sequence
  Description of Artificial Sequence: Synthetic peptide
EPMLM

SEQ ID NO: 1133 - protein, 5 aa, Artificial Sequence
  Description of Artificial Sequence: Synthetic peptide
GHMVR

SEQ ID NO: 1134 - protein, 5 aa, Artificial Sequence
  Description of Artificial Sequence: Synthetic peptide
THMRT

SEQ ID NO: 1135 - protein, 5 aa, Artificial Sequence
  Description of Artificial Sequence: Synthetic peptide
PHMKR

SEQ ID NO: 1136 - protein, 5 aa, Artificial Sequence
  Description of Artificial Sequence: Synthetic peptide
EHMRQ

SEQ ID NO: 1137 - protein, 5 aa, Artificial Sequence
  Description of Artificial Sequence: Synthetic peptide
EHMRT

SEQ ID NO: 1138 - protein, 5 aa, Artificial Sequence
  Description of Artificial Sequence: Synthetic peptide
DHMSR

SEQ ID NO: 1139 - protein, 5 aa, Artificial Sequence
  Description of Artificial Sequence: Synthetic peptide
ETMMI

SEQ ID NO: 1140 - protein, 5 aa, Artificial Sequence
  Description of Artificial Sequence: Synthetic peptide
SHMKL

SEQ ID NO: 1141 - protein, 5 aa, Artificial Sequence
  Description of Artificial Sequence: Synthetic peptide
TPMKL

SEQ ID NO: 1142 - protein, 5 aa, Artificial Sequence
  Description of Artificial Sequence: Synthetic peptide
GHMKM

SEQ ID NO: 1143 - protein, 5 aa, Artificial Sequence
  Description of Artificial Sequence: Synthetic peptide
RQMLI

SEQ ID NO: 1144 - protein, 5 aa, Artificial Sequence
  Description of Artificial Sequence: Synthetic peptide
GHMRM

SEQ ID NO: 1145 - protein, 5 aa, Artificial Sequence
  Description of Artificial Sequence: Synthetic peptide
EGMKR

SEQ ID NO: 1146 - protein, 5 aa, Artificial Sequence
  Description of Artificial Sequence: Synthetic peptide
EHMKA

SEQ ID NO: 1147 - protein, 5 aa, Artificial Sequence
  Description of Artificial Sequence: Synthetic peptide
QIMPL

SEQ ID NO: 1148 - protein, 5 aa, Artificial Sequence
  Description of Artificial Sequence: Synthetic peptide
SHMKV

SEQ ID NO: 1149 - protein, 5 aa, Artificial Sequence
  Description of Artificial Sequence: Synthetic peptide
SGMNR

SEQ ID NO: 1150 - protein, 5 aa, Artificial Sequence
  Description of Artificial Sequence: Synthetic peptide
THMAR

SEQ ID NO: 1151 - protein, 5 aa, Artificial Sequence
  Description of Artificial Sequence: Synthetic peptide
QGMKR

SEQ ID NO: 1152 - protein, 5 aa, Artificial Sequence
  Description of Artificial Sequence: Synthetic peptide
TKMEG

SEQ ID NO: 1153 - protein, 5 aa, Artificial Sequence
  Description of Artificial Sequence: Synthetic peptide
RPMGR

SEQ ID NO: 1154 - protein, 5 aa, Artificial Sequence
  Description of Artificial Sequence: Synthetic peptide
VHMRR

SEQ ID NO: 1155 - protein, 5 aa, Artificial Sequence
  Description of Artificial Sequence: Synthetic peptide
THMRV

SEQ ID NO: 1156 - protein, 5 aa, Artificial Sequence
  Description of Artificial Sequence: Synthetic peptide
NHMKS

SEQ ID NO: 1157 - protein, 5 aa, Artificial Sequence
  Description of Artificial Sequence: Synthetic peptide
AAMST

SEQ ID NO: 1158 - protein, 5 aa, Artificial Sequence
  Description of Artificial Sequence: Synthetic peptide
GKMRD

SEQ ID NO: 1159 - protein, 5 aa, Artificial Sequence
  Description of Artificial Sequence: Synthetic peptide
THMEL

SEQ ID NO: 1160 - protein, 5 aa, Artificial Sequence
  Description of Artificial Sequence: Synthetic peptide
TPMRV

SEQ ID NO: 1161 - protein, 5 aa, Artificial Sequence
  Description of Artificial Sequence: Synthetic peptide
SPMRV

SEQ ID NO: 1162 - protein, 5 aa, Artificial Sequence
  Description of Artificial Sequence: Synthetic peptide
THMGV

SEQ ID NO: 1163 - protein, 5 aa, Artificial Sequence
  Description of Artificial Sequence: Synthetic peptide
MGMGR

SEQ ID NO: 1164 - protein, 5 aa, Artificial Sequence
  Description of Artificial Sequence: Synthetic peptide
GKPSM

SEQ ID NO: 1165 - protein, 5 aa, Artificial Sequence
  Description of Artificial Sequence: Synthetic peptide
SHMRV

SEQ ID NO: 1166 - protein, 5 aa, Artificial Sequence
  Description of Artificial Sequence: Synthetic peptide
SPMNR

SEQ ID NO: 1167 - protein, 5 aa, Artificial Sequence
  Description of Artificial Sequence: Synthetic peptide
SAMNR

SEQ ID NO: 1168 - protein, 5 aa, Artificial Sequence
  Description of Artificial Sequence: Synthetic peptide
SHMSR

SEQ ID NO: 1169 - protein, 5 aa, Artificial Sequence
  Description of Artificial Sequence: Synthetic peptide
NGMPR

SEQ ID NO: 1170 - protein, 5 aa, Artificial Sequence
  Description of Artificial Sequence: Synthetic peptide
SPMRR

SEQ ID NO: 1171 - protein, 5 aa, Artificial Sequence
  Description of Artificial Sequence: Synthetic peptide
GHMGV

SEQ ID NO: 1172 - protein, 5 aa, Artificial Sequence
  Description of Artificial Sequence: Synthetic peptide
THMRL

SEQ ID NO: 1173 - protein, 5 aa, Artificial Sequence
  Description of Artificial Sequence: Synthetic peptide
QHMKR

SEQ ID NO: 1174 - protein, 5 aa, Artificial Sequence
  Description of Artificial Sequence: Synthetic peptide
THMGR

SEQ ID NO: 1175 - protein, 5 aa, Artificial Sequence
  Description of Artificial Sequence: Synthetic peptide
THMQR

SEQ ID NO: 1176 - protein, 5 aa, Artificial Sequence
  Description of Artificial Sequence: Synthetic peptide
RHMKR

SEQ ID NO: 1177 - protein, 5 aa, Artificial Sequence
  Description of Artificial Sequence: Synthetic peptide
EHMRV

SEQ ID NO: 1178 - protein, 5 aa, Artificial Sequence
  Description of Artificial Sequence: Synthetic peptide
KHMKR

SEQ ID NO: 1179 - protein, 5 aa, Artificial Sequence
  Description of Artificial Sequence: Synthetic peptide
QHMNR

SEQ ID NO: 1180 - protein, 5 aa, Artificial Sequence
  Description of Artificial Sequence: Synthetic peptide
RAMKV

SEQ ID NO: 1181 - protein, 5 aa, Artificial Sequence
  Description of Artificial Sequence: Synthetic peptide
GHMRV

SEQ ID NO: 1182 - protein, 5 aa, Artificial Sequence
  Description of Artificial Sequence: Synthetic peptide
TPMGV

SEQ ID NO: 1183 - protein, 5 aa, Artificial Sequence
  Description of Artificial Sequence: Synthetic peptide
GHMKV

SEQ ID NO: 1184 - protein, 5 aa, Artificial Sequence
  Description of Artificial Sequence: Synthetic peptide
RHMNR

SEQ ID NO: 1185 - protein, 5 aa, Artificial Sequence
  Description of Artificial Sequence: Synthetic peptide
TPMEL

SEQ ID NO: 1186 - protein, 5 aa, Artificial Sequence
  Description of Artificial Sequence: Synthetic peptide
SPMKL

SEQ ID NO: 1187 - protein, 5 aa, Artificial Sequence
  Description of Artificial Sequence: Synthetic peptide
SPMKR

SEQ ID NO: 1188 - protein, 5 aa, Artificial Sequence
  Description of Artificial Sequence: Synthetic peptide
LAMEE

SEQ ID NO: 1189 - protein, 5 aa, Artificial Sequence
  Description of Artificial Sequence: Synthetic peptide
PGMMS

SEQ ID NO: 1190 - protein, 5 aa, Artificial Sequence
  Description of Artificial Sequence: Synthetic peptide
SHMEV

SEQ ID NO: 1191 - protein, 5 aa, Artificial Sequence
  Description of Artificial Sequence: Synthetic peptide
GMMLT

SEQ ID NO: 1192 - protein, 5 aa, Artificial Sequence
  Description of Artificial Sequence: Synthetic peptide
TPMKG

SEQ ID NO: 1193 - protein, 5 aa, Artificial Sequence
  Description of Artificial Sequence: Synthetic peptide
THMHR

SEQ ID NO: 1194 - protein, 5 aa, Artificial Sequence
  Description of Artificial Sequence: Synthetic peptide
SHMGV

SEQ ID NO: 1195 - protein, 5 aa, Artificial Sequence
  Description of Artificial Sequence: Synthetic peptide
THMKS

SEQ ID NO: 1196 - protein, 5 aa, Artificial Sequence
  Description of Artificial Sequence: Synthetic peptide
THMRG

SEQ ID NO: 1197 - protein, 5 aa, Artificial Sequence
  Description of Artificial Sequence: Synthetic peptide
GHMKT

SEQ ID NO: 1198 - protein, 5 aa, Artificial Sequence
  Description of Artificial Sequence: Synthetic peptide
THMRS

SEQ ID NO: 1199 - protein, 5 aa, Artificial Sequence
  Description of Artificial Sequence: Synthetic peptide
NHMQR

SEQ ID NO: 1200 - protein, 5 aa, Artificial Sequence
  Description of Artificial Sequence: Synthetic peptide
SHMAR

SEQ ID NO: 1201 - protein, 5 aa, Artificial Sequence
  Description of Artificial Sequence: Synthetic peptide
EAMKR

SEQ ID NO: 1202 - protein, 5 aa, Artificial Sequence
  Description of Artificial Sequence: Synthetic peptide
GSMRE

SEQ ID NO: 1203 - protein, 5 aa, Artificial Sequence
  Description of Artificial Sequence: Synthetic peptide
SPMEL

SEQ ID NO: 1204 - protein, 5 aa, Artificial Sequence
  Description of Artificial Sequence: Synthetic peptide
AHMAR

SEQ ID NO: 1205 - protein, 5 aa, Artificial Sequence
  Description of Artificial Sequence: Synthetic peptide
PPMMV

SEQ ID NO: 1206 - protein, 5 aa, Artificial Sequence
  Description of Artificial Sequence: Synthetic peptide
KHMNR

SEQ ID NO: 1207 - protein, 5 aa, Artificial Sequence
  Description of Artificial Sequence: Synthetic peptide
TPMKR

SEQ ID NO: 1208 - protein, 5 aa, Artificial Sequence
  Description of Artificial Sequence: Synthetic peptide
QSMKR

SEQ ID NO: 1209 - protein, 5 aa, Artificial Sequence
  Description of Artificial Sequence: Synthetic peptide
RHMRR

SEQ ID NO: 1210 - protein, 5 aa, Artificial Sequence
  Description of Artificial Sequence: Synthetic peptide
DHMQR

SEQ ID NO: 1211 - protein, 5 aa, Artificial Sequence
  Description of Artificial Sequence: Synthetic peptide
AHMSR

SEQ ID NO: 1212 - protein, 5 aa, Artificial Sequence
  Description of Artificial Sequence: Synthetic peptide
EHMRS

SEQ ID NO: 1213 - protein, 5 aa, Artificial Sequence
  Description of Artificial Sequence: Synthetic peptide
AHMTR

SEQ ID NO: 1214 - protein, 5 aa, Artificial Sequence
  Description of Artificial Sequence: Synthetic peptide
GHINR

SEQ ID NO: 1215 - protein, 5 aa, Artificial Sequence
  Description of Artificial Sequence: Synthetic peptide
EYMRR

SEQ ID NO: 1216 - protein, 5 aa, Artificial Sequence
  Description of Artificial Sequence: Synthetic peptide
GQMNR

SEQ ID NO: 1217 - protein, 5 aa, Artificial Sequence
  Description of Artificial Sequence: Synthetic peptide
GHMKE

SEQ ID NO: 1218 - protein, 5 aa, Artificial Sequence
  Description of Artificial Sequence: Synthetic peptide
EHMMR

SEQ ID NO: 1219 - protein, 5 aa, Artificial Sequence
  Description of Artificial Sequence: Synthetic peptide
SHMRL

SEQ ID NO: 1220 - protein, 5 aa, Artificial Sequence
  Description of Artificial Sequence: Synthetic peptide
GGMKA

SEQ ID NO: 1221 - protein, 5 aa, Artificial Sequence
  Description of Artificial Sequence: Synthetic peptide
EHMPR

SEQ ID NO: 1222 - protein, 5 aa, Artificial Sequence
  Description of Artificial Sequence: Synthetic peptide
AHMKS

SEQ ID NO: 1223 - protein, 5 aa, Artificial Sequence
  Description of Artificial Sequence: Synthetic peptide
AHMQR

SEQ ID NO: 1224 - protein, 5 aa, Artificial Sequence
  Description of Artificial Sequence: Synthetic peptide
GHTRR

SEQ ID NO: 1225 - protein, 5 aa, Artificial Sequence
  Description of Artificial Sequence: Synthetic peptide
GHMKG

SEQ ID NO: 1226 - protein, 5 aa, Artificial Sequence
  Description of Artificial Sequence: Synthetic peptide
EPMKV

SEQ ID NO: 1227 - protein, 5 aa, Artificial Sequence
  Description of Artificial Sequence: Synthetic peptide
EHMAK

SEQ ID NO: 1228 - protein, 5 aa, Artificial Sequence
  Description of Artificial Sequence: Synthetic peptide
GYMNR

SEQ ID NO: 1229 - protein, 5 aa, Artificial Sequence
  Description of Artificial Sequence: Synthetic peptide
THMSS

SEQ ID NO: 1230 - protein, 5 aa, Artificial Sequence
  Description of Artificial Sequence: Synthetic peptide
GDMNR

SEQ ID NO: 1231 - protein, 5 aa, Artificial Sequence
  Description of Artificial Sequence: Synthetic peptide
GHMRT

SEQ ID NO: 1232 - protein, 5 aa, Artificial Sequence
  Description of Artificial Sequence: Synthetic peptide
QRMGV

SEQ ID NO: 1233 - protein, 5 aa, Artificial Sequence
  Description of Artificial Sequence: Synthetic peptide
GSMRQ

SEQ ID NO: 1234 - protein, 5 aa, Artificial Sequence
  Description of Artificial Sequence: Synthetic peptide
DHMTR

SEQ ID NO: 1235 - protein, 5 aa, Artificial Sequence
  Description of Artificial Sequence: Synthetic peptide
VEMER

SEQ ID NO: 1236 - protein, 5 aa, Artificial Sequence
  Description of Artificial Sequence: Synthetic peptide
SPMEV

SEQ ID NO: 1237 - protein, 5 aa, Artificial Sequence
  Description of Artificial Sequence: Synthetic peptide
GPMKV

SEQ ID NO: 1238 - protein, 5 aa, Artificial Sequence
  Description of Artificial Sequence: Synthetic peptide
TPMER

SEQ ID NO: 1239 - protein, 5 aa, Artificial Sequence
  Description of Artificial Sequence: Synthetic peptide
EHMDR

SEQ ID NO: 1240 - protein, 5 aa, Artificial Sequence
  Description of Artificial Sequence: Synthetic peptide
EHVRR

SEQ ID NO: 1241 - protein, 5 aa, Artificial Sequence
  Description of Artificial Sequence: Synthetic peptide
GGMAR

SEQ ID NO: 1242 - protein, 5 aa, Artificial Sequence
  Description of Artificial Sequence: Synthetic peptide
HHMKR

SEQ ID NO: 1243 - protein, 5 aa, Artificial Sequence
  Description of Artificial Sequence: Synthetic peptide
GHMRS

SEQ ID NO: 1244 - protein, 5 aa, Artificial Sequence
  Description of Artificial Sequence: Synthetic peptide
EYMAR

SEQ ID NO: 1245 - protein, 5 aa, Artificial Sequence
  Description of Artificial Sequence: Synthetic peptide
KHMRR

SEQ ID NO: 1246 - protein, 5 aa, Artificial Sequence
  Description of Artificial Sequence: Synthetic peptide
EHMSS

SEQ ID NO: 1247 - protein, 5 aa, Artificial Sequence
  Description of Artificial Sequence: Synthetic peptide
TPMRL

SEQ ID NO: 1248 - protein, 5 aa, Artificial Sequence
  Description of Artificial Sequence: Synthetic peptide
GHMSL

SEQ ID NO: 1249 - protein, 5 aa, Artificial Sequence
  Description of Artificial Sequence: Synthetic peptide
VHMKR

SEQ ID NO: 1250 - protein, 5 aa, Artificial Sequence
  Description of Artificial Sequence: Synthetic peptide
GHTNR

SEQ ID NO: 1251 - protein, 5 aa, Artificial Sequence
  Description of Artificial Sequence: Synthetic peptide
GPMRT

SEQ ID NO: 1252 - protein, 5 aa, Artificial Sequence
  Description of Artificial Sequence: Synthetic peptide
EQMRR

SEQ ID NO: 1253 - protein, 5 aa, Artificial Sequence
  Description of Artificial Sequence: Synthetic peptide
EHMKS

SEQ ID NO: 1254 - protein, 5 aa, Artificial Sequence
  Description of Artificial Sequence: Synthetic peptide
THMKM

SEQ ID NO: 1255 - protein, 5 aa, Artificial Sequence
  Description of Artificial Sequence: Synthetic peptide
GTMKM

SEQ ID NO: 1256 - protein, 5 aa, Artificial Sequence
  Description of Artificial Sequence: Synthetic peptide
VHRIR

SEQ ID NO: 1257 - protein, 5 aa, Artificial Sequence
  Description of Artificial Sequence: Synthetic peptide
DHMNK

SEQ ID NO: 1258 - protein, 5 aa, Artificial Sequence
  Description of Artificial Sequence: Synthetic peptide
TPMNM

SEQ ID NO: 1259 - protein, 5 aa, Artificial Sequence
  Description of Artificial Sequence: Synthetic peptide
RQMII

SEQ ID NO: 1260 - protein, 5 aa, Artificial Sequence
  Description of Artificial Sequence: Synthetic peptide
EHMRW

SEQ ID NO: 1261 - protein, 5 aa, Artificial Sequence
  Description of Artificial Sequence: Synthetic peptide
SPMRL

SEQ ID NO: 1262 - protein, 5 aa, Artificial Sequence
  Description of Artificial Sequence: Synthetic peptide
GVMRA

SEQ ID NO: 1263 - protein, 5 aa, Artificial Sequence
  Description of Artificial Sequence: Synthetic peptide
GHMQV

SEQ ID NO: 1264 - protein, 5 aa, Artificial Sequence
  Description of Artificial Sequence: Synthetic peptide
GPMKL

SEQ ID NO: 1265 - protein, 5 aa, Artificial Sequence
  Description of Artificial Sequence: Synthetic peptide
IDMKR

SEQ ID NO: 1266 - protein, 5 aa, Artificial Sequence
  Description of Artificial Sequence: Synthetic peptide
PGMMG

SEQ ID NO: 1267 - protein, 5 aa, Artificial Sequence
  Description of Artificial Sequence: Synthetic peptide
KHMER

SEQ ID NO: 1268 - protein, 5 aa, Artificial Sequence
  Description of Artificial Sequence: Synthetic peptide
TPMNV

SEQ ID NO: 1269 - protein, 5 aa, Artificial Sequence
  Description of Artificial Sequence: Synthetic peptide
EHVQR

SEQ ID NO: 1270 - protein, 5 aa, Artificial Sequence
  Description of Artificial Sequence: Synthetic peptide
ENMKE

SEQ ID NO: 1271 - protein, 5 aa, Artificial Sequence
  Description of Artificial Sequence: Synthetic peptide
DHMKM

SEQ ID NO: 1272 - protein, 5 aa, Artificial Sequence
  Description of Artificial Sequence: Synthetic peptide
SHMNQ

SEQ ID NO: 1273 - protein, 5 aa, Artificial Sequence
  Description of Artificial Sequence: Synthetic peptide
GLMKR

SEQ ID NO: 1274 - protein, 5 aa, Artificial Sequence
  Description of Artificial Sequence: Synthetic peptide
APMNL

SEQ ID NO: 1275 - protein, 5 aa, Artificial Sequence
  Description of Artificial Sequence: Synthetic peptide
RHMSR

SEQ ID NO: 1276 - protein, 5 aa, Artificial Sequence
  Description of Artificial Sequence: Synthetic peptide
EHMRG

SEQ ID NO: 1277 - protein, 5 aa, Artificial Sequence
  Description of Artificial Sequence: Synthetic peptide
DWMRR

SEQ ID NO: 1278 - protein, 5 aa, Artificial Sequence
  Description of Artificial Sequence: Synthetic peptide
GHMRH

SEQ ID NO: 1279 - protein, 5 aa, Artificial Sequence
  Description of Artificial Sequence: Synthetic peptide
QNMHR

SEQ ID NO: 1280 - protein, 5 aa, Artificial Sequence
  Description of Artificial Sequence: Synthetic peptide
CHMRR

SEQ ID NO: 1281 - protein, 5 aa, Artificial Sequence
  Description of Artificial Sequence: Synthetic peptide
ERMRR

SEQ ID NO: 1282 - protein, 5 aa, Artificial Sequence
  Description of Artificial Sequence: Synthetic peptide
EHMKE

SEQ ID NO: 1283 - protein, 5 aa, Artificial Sequence
  Description of Artificial Sequence: Synthetic peptide
EPMKR

SEQ ID NO: 1284 - protein, 5 aa, Artificial Sequence
  Description of Artificial Sequence: Synthetic peptide
AHINR

SEQ ID NO: 1285 - protein, 5 aa, Artificial Sequence
  Description of Artificial Sequence: Synthetic peptide
SHMRT

SEQ ID NO: 1286 - protein, 5 aa, Artificial Sequence
  Description of Artificial Sequence: Synthetic peptide
PHMNR

SEQ ID NO: 1287 - protein, 5 aa, Artificial Sequence
  Description of Artificial Sequence: Synthetic peptide
AHMKV

SEQ ID NO: 1288 - protein, 5 aa, Artificial Sequence
  Description of Artificial Sequence: Synthetic peptide
THMGM

SEQ ID NO: 1289 - protein, 5 aa, Artificial Sequence
  Description of Artificial Sequence: Synthetic peptide
NGMKM

SEQ ID NO: 1290 - protein, 5 aa, Artificial Sequence
  Description of Artificial Sequence: Synthetic peptide
EKMKR

SEQ ID NO: 1291 - protein, 5 aa, Artificial Sequence
  Description of Artificial Sequence: Synthetic peptide
EHMIR

SEQ ID NO: 1292 - protein, 5 aa, Artificial Sequence
  Description of Artificial Sequence: Synthetic peptide
NNMHR

SEQ ID NO: 1293 - protein, 5 aa, Artificial Sequence
  Description of Artificial Sequence: Synthetic peptide
GNMNR

SEQ ID NO: 1294 - protein, 5 aa, Artificial Sequence
  Description of Artificial Sequence: Synthetic peptide
KRMQR

SEQ ID NO: 1295 - protein, 5 aa, Artificial Sequence
  Description of Artificial Sequence: Synthetic peptide
EKMRR

SEQ ID NO: 1296 - protein, 5 aa, Artificial Sequence
  Description of Artificial Sequence: Synthetic peptide
TQMKQ

SEQ ID NO: 1297 - protein, 5 aa, Artificial Sequence
  Description of Artificial Sequence: Synthetic peptide
EHMKV

SEQ ID NO: 1298 - protein, 5 aa, Artificial Sequence
  Description of Artificial Sequence: Synthetic peptide
DHMKE

SEQ ID NO: 1299 - protein, 5 aa, Artificial Sequence
  Description of Artificial Sequence: Synthetic peptide
EHTTR

SEQ ID NO: 1300 - protein, 5 aa, Artificial Sequence
  Description of Artificial Sequence: Synthetic peptide
SPMRM

SEQ ID NO: 1301 - protein, 5 aa, Artificial Sequence
  Description of Artificial Sequence: Synthetic peptide
GKMNR

SEQ ID NO: 1302 - protein, 5 aa, Artificial Sequence
  Description of Artificial Sequence: Synthetic peptide
TNMKR

SEQ ID NO: 1303 - protein, 5 aa, Artificial Sequence
  Description of Artificial Sequence: Synthetic peptide
THKRR

SEQ ID NO: 1304 - protein, 5 aa, Artificial Sequence
  Description of Artificial Sequence: Synthetic peptide
SQTNR

SEQ ID NO: 1305 - protein, 5 aa, Artificial Sequence
  Description of Artificial Sequence: Synthetic peptide
THLKR

SEQ ID NO: 1306 - protein, 5 aa, Artificial Sequence
  Description of Artificial Sequence: Synthetic peptide
SHMQS

SEQ ID NO: 1307 - protein, 5 aa, Artificial Sequence
  Description of Artificial Sequence: Synthetic peptide
THMSV

SEQ ID NO: 1308 - protein, 5 aa, Artificial Sequence
  Description of Artificial Sequence: Synthetic peptide
THMRH

SEQ ID NO: 1309 - protein, 5 aa, Artificial Sequence
  Description of Artificial Sequence: Synthetic peptide
DPMKV

SEQ ID NO: 1310 - protein, 5 aa, Artificial Sequence
  Description of Artificial Sequence: Synthetic peptide
PHMMS

SEQ ID NO: 1311 - protein, 5 aa, Artificial Sequence
  Description of Artificial Sequence: Synthetic peptide
SHVKR

SEQ ID NO: 1312 - protein, 5 aa, Artificial Sequence
  Description of Artificial Sequence: Synthetic peptide
SHMGL

SEQ ID NO: 1313 - protein, 5 aa, Artificial Sequence
  Description of Artificial Sequence: Synthetic peptide
TDMVA

SEQ ID NO: 1314 - protein, 5 aa, Artificial Sequence
  Description of Artificial Sequence: Synthetic peptide
PQMMS

SEQ ID NO: 1315 - protein, 5 aa, Artificial Sequence
  Description of Artificial Sequence: Synthetic peptide
KHMQR

SEQ ID NO: 1316 - protein, 5 aa, Artificial Sequence
  Description of Artificial Sequence: Synthetic peptide
EHMQL

SEQ ID NO: 1317 - protein, 5 aa, Artificial Sequence
  Description of Artificial Sequence: Synthetic peptide
EHISR

SEQ ID NO: 1318 - protein, 5 aa, Artificial Sequence
  Description of Artificial Sequence: Synthetic peptide
SHMKK

SEQ ID NO: 1319 - protein, 5 aa, Artificial Sequence
  Description of Artificial Sequence: Synthetic peptide
EQMTR

SEQ ID NO: 1320 - protein, 5 aa, Artificial Sequence
  Description of Artificial Sequence: Synthetic peptide
TPMRG

SEQ ID NO: 1321 - protein, 5 aa, Artificial Sequence
  Description of Artificial Sequence: Synthetic peptide
GHISR

SEQ ID NO: 1322 - protein, 5 aa, Artificial Sequence
  Description of Artificial Sequence: Synthetic peptide
GPMGV

SEQ ID NO: 1323 - protein, 5 aa, Artificial Sequence
  Description of Artificial Sequence: Synthetic peptide
GYMRR

SEQ ID NO: 1324 - protein, 5 aa, Artificial Sequence
  Description of Artificial Sequence: Synthetic peptide
GHMTV

SEQ ID NO: 1325 - protein, 5 aa, Artificial Sequence
  Description of Artificial Sequence: Synthetic peptide
APMIM

SEQ ID NO: 1326 - protein, 5 aa, Artificial Sequence
  Description of Artificial Sequence: Synthetic peptide
THINR

SEQ ID NO: 1327 - protein, 5 aa, Artificial Sequence
  Description of Artificial Sequence: Synthetic peptide
DHMMS

SEQ ID NO: 1328 - protein, 5 aa, Artificial Sequence
  Description of Artificial Sequence: Synthetic peptide
GHMKL

SEQ ID NO: 1329 - protein, 5 aa, Artificial Sequence
  Description of Artificial Sequence: Synthetic peptide
EKMEE

SEQ ID NO: 1330 - protein, 5 aa, Artificial Sequence
  Description of Artificial Sequence: Synthetic peptide
DPMRM

SEQ ID NO: 1331 - protein, 5 aa, Artificial Sequence
  Description of Artificial Sequence: Synthetic peptide
SHMKT

SEQ ID NO: 1332 - protein, 5 aa, Artificial Sequence
  Description of Artificial Sequence: Synthetic peptide
SPMGL

SEQ ID NO: 1333 - protein, 5 aa, Artificial Sequence
  Description of Artificial Sequence: Synthetic peptide
SPMGE

SEQ ID NO: 1334 - protein, 5 aa, Artificial Sequence
  Description of Artificial Sequence: Synthetic peptide
DHISR

SEQ ID NO: 1335 - protein, 5 aa, Artificial Sequence
  Description of Artificial Sequence: Synthetic peptide
TPMKQ

SEQ ID NO: 1336 - protein, 5 aa, Artificial Sequence
  Description of Artificial Sequence: Synthetic peptide
GHMKW

SEQ ID NO: 1337 - protein, 5 aa, Artificial Sequence
  Description of Artificial Sequence: Synthetic peptide
EHMCR

SEQ ID NO: 1338 - protein, 5 aa, Artificial Sequence
  Description of Artificial Sequence: Synthetic peptide
NNMKR

SEQ ID NO: 1339 - protein, 5 aa, Artificial Sequence
  Description of Artificial Sequence: Synthetic peptide
ESMKR

SEQ ID NO: 1340 - protein, 5 aa, Artificial Sequence
  Description of Artificial Sequence: Synthetic peptide
TEMLI

SEQ ID NO: 1341 - protein, 5 aa, Artificial Sequence
  Description of Artificial Sequence: Synthetic peptide
SHMKM

SEQ ID NO: 1342 - protein, 5 aa, Artificial Sequence
  Description of Artificial Sequence: Synthetic peptide
EHVNR

SEQ ID NO: 1343 - protein, 5 aa, Artificial Sequence
  Description of Artificial Sequence: Synthetic peptide
GHMER

SEQ ID NO: 1344 - protein, 5 aa, Artificial Sequence
  Description of Artificial Sequence: Synthetic peptide
NHMDR

SEQ ID NO: 1345 - protein, 5 aa, Artificial Sequence
  Description of Artificial Sequence: Synthetic peptide
GHMWR

SEQ ID NO: 1346 - protein, 5 aa, Artificial Sequence
  Description of Artificial Sequence: Synthetic peptide
THMKI

SEQ ID NO: 1347 - protein, 5 aa, Artificial Sequence
  Description of Artificial Sequence: Synthetic peptide
QKMKE

SEQ ID NO: 1348 - protein, 5 aa, Artificial Sequence
  Description of Artificial Sequence: Synthetic peptide
THMNK

SEQ ID NO: 1349 - protein, 5 aa, Artificial Sequence
  Description of Artificial Sequence: Synthetic peptide
AHMKQ

SEQ ID NO: 1350 - protein, 5 aa, Artificial Sequence
  Description of Artificial Sequence: Synthetic peptide
DHMGR

SEQ ID NO: 1351 - protein, 5 aa, Artificial Sequence
  Description of Artificial Sequence: Synthetic peptide
EGMKW

SEQ ID NO: 1352 - protein, 5 aa, Artificial Sequence
  Description of Artificial Sequence: Synthetic peptide
TQMKE

SEQ ID NO: 1353 - protein, 5 aa, Artificial Sequence
  Description of Artificial Sequence: Synthetic peptide
TRMRR

SEQ ID NO: 1354 - protein, 5 aa, Artificial Sequence
  Description of Artificial Sequence: Synthetic peptide
AHMGR

SEQ ID NO: 1355 - protein, 5 aa, Artificial Sequence
  Description of Artificial Sequence: Synthetic peptide
TRMKR

SEQ ID NO: 1356 - protein, 5 aa, Artificial Sequence
  Description of Artificial Sequence: Synthetic peptide
KNLTR

SEQ ID NO: 1357 - protein, 5 aa, Artificial Sequence
  Description of Artificial Sequence: Synthetic peptide
PEMMS

SEQ ID NO: 1358 - protein, 5 aa, Artificial Sequence
  Description of Artificial Sequence: Synthetic peptide
EHLTL

SEQ ID NO: 1359 - protein, 5 aa, Artificial Sequence
  Description of Artificial Sequence: Synthetic peptide
RHMKV

SEQ ID NO: 1360 - protein, 5 aa, Artificial Sequence
  Description of Artificial Sequence: Synthetic peptide
PGMIR

SEQ ID NO: 1361 - protein, 5 aa, Artificial Sequence
  Description of Artificial Sequence: Synthetic peptide
THTKR

SEQ ID NO: 1362 - protein, 5 aa, Artificial Sequence
  Description of Artificial Sequence: Synthetic peptide
EHIRR

SEQ ID NO: 1363 - protein, 5 aa, Artificial Sequence
  Description of Artificial Sequence: Synthetic peptide
THMPR

SEQ ID NO: 1364 - protein, 5 aa, Artificial Sequence
  Description of Artificial Sequence: Synthetic peptide
GKMKQ

SEQ ID NO: 1365 - protein, 5 aa, Artificial Sequence
  Description of Artificial Sequence: Synthetic peptide
GPMRV

SEQ ID NO: 1366 - protein, 5 aa, Artificial Sequence
  Description of Artificial Sequence: Synthetic peptide
AHVNR

SEQ ID NO: 1367 - protein, 5 aa, Artificial Sequence
  Description of Artificial Sequence: Synthetic peptide
EPMSR

SEQ ID NO: 1368 - protein, 5 aa, Artificial Sequence
  Description of Artificial Sequence: Synthetic peptide
PRMMV

SEQ ID NO: 1369 - protein, 5 aa, Artificial Sequence
  Description of Artificial Sequence: Synthetic peptide
ELMSR

SEQ ID NO: 1370 - protein, 5 aa, Artificial Sequence
  Description of Artificial Sequence: Synthetic peptide
SNMNR

SEQ ID NO: 1371 - protein, 5 aa, Artificial Sequence
  Description of Artificial Sequence: Synthetic peptide
TSMKT

SEQ ID NO: 1372 - protein, 5 aa, Artificial Sequence
  Description of Artificial Sequence: Synthetic peptide
GNMHR

SEQ ID NO: 1373 - protein, 5 aa, Artificial Sequence
  Description of Artificial Sequence: Synthetic peptide
TQMRR

SEQ ID NO: 1374 - protein, 5 aa, Artificial Sequence
  Description of Artificial Sequence: Synthetic peptide
SHMKG

SEQ ID NO: 1375 - protein, 5 aa, Artificial Sequence
  Description of Artificial Sequence: Synthetic peptide
DHMRT

SEQ ID NO: 1376 - protein, 5 aa, Artificial Sequence
  Description of Artificial Sequence: Synthetic peptide
EHMRE

SEQ ID NO: 1377 - protein, 5 aa, Artificial Sequence
  Description of Artificial Sequence: Synthetic peptide
SQLNR

SEQ ID NO: 1378 - protein, 5 aa, Artificial Sequence
  Description of Artificial Sequence: Synthetic peptide
SHMGR

SEQ ID NO: 1379 - protein, 5 aa, Artificial Sequence
  Description of Artificial Sequence: Synthetic peptide
GHKNR

SEQ ID NO: 1380 - protein, 5 aa, Artificial Sequence
  Description of Artificial Sequence: Synthetic peptide
THMNL

SEQ ID NO: 1381 - protein, 5 aa, Artificial Sequence
  Description of Artificial Sequence: Synthetic peptide
GYMKR

SEQ ID NO: 1382 - protein, 5 aa, Artificial Sequence
  Description of Artificial Sequence: Synthetic peptide
SNMKV

SEQ ID NO: 1383 - protein, 5 aa, Artificial Sequence
  Description of Artificial Sequence: Synthetic peptide
GHMRC

SEQ ID NO: 1384 - protein, 5 aa, Artificial Sequence
  Description of Artificial Sequence: Synthetic peptide
NHMRV

SEQ ID NO: 1385 - protein, 5 aa, Artificial Sequence
  Description of Artificial Sequence: Synthetic peptide
SGMKT

SEQ ID NO: 1386 - protein, 5 aa, Artificial Sequence
  Description of Artificial Sequence: Synthetic peptide
EHLRR

SEQ ID NO: 1387 - protein, 5 aa, Artificial Sequence
  Description of Artificial Sequence: Synthetic peptide
VPMRR

SEQ ID NO: 1388 - protein, 5 aa, Artificial Sequence
  Description of Artificial Sequence: Synthetic peptide
DLMKR

SEQ ID NO: 1389 - protein, 5 aa, Artificial Sequence
  Description of Artificial Sequence: Synthetic peptide
TSMKL

SEQ ID NO: 1390 - protein, 5 aa, Artificial Sequence
  Description of Artificial Sequence: Synthetic peptide
APMTV

SEQ ID NO: 1391 - protein, 5 aa, Artificial Sequence
  Description of Artificial Sequence: Synthetic peptide
EHMLM

SEQ ID NO: 1392 - protein, 5 aa, Artificial Sequence
  Description of Artificial Sequence: Synthetic peptide
EKMNR

SEQ ID NO: 1393 - protein, 5 aa, Artificial Sequence
  Description of Artificial Sequence: Synthetic peptide
THRRR

SEQ ID NO: 1394 - protein, 5 aa, Artificial Sequence
  Description of Artificial Sequence: Synthetic peptide
ERMNR

SEQ ID NO: 1395 - protein, 5 aa, Artificial Sequence
  Description of Artificial Sequence: Synthetic peptide
NHMHR

SEQ ID NO: 1396 - protein, 5 aa, Artificial Sequence
  Description of Artificial Sequence: Synthetic peptide
DLMNR

SEQ ID NO: 1397 - protein, 5 aa, Artificial Sequence
  Description of Artificial Sequence: Synthetic peptide
GQMQR

SEQ ID NO: 1398 - protein, 5 aa, Artificial Sequence
  Description of Artificial Sequence: Synthetic peptide
RGMMI

SEQ ID NO: 1399 - protein, 5 aa, Artificial Sequence
  Description of Artificial Sequence: Synthetic peptide
TQMKR

SEQ ID NO: 1400 - protein, 5 aa, Artificial Sequence
  Description of Artificial Sequence: Synthetic peptide
EHMGV

SEQ ID NO: 1401 - protein, 5 aa, Artificial Sequence
  Description of Artificial Sequence: Synthetic peptide
AHMTQ

SEQ ID NO: 1402 - protein, 5 aa, Artificial Sequence
  Description of Artificial Sequence: Synthetic peptide
TPMMV

SEQ ID NO: 1403 - protein, 5 aa, Artificial Sequence
  Description of Artificial Sequence: Synthetic peptide
GHKRR

SEQ ID NO: 1404 - protein, 5 aa, Artificial Sequence
  Description of Artificial Sequence: Synthetic peptide
GPMER

SEQ ID NO: 1405 - protein, 5 aa, Artificial Sequence
  Description of Artificial Sequence: Synthetic peptide
EPMQV

SEQ ID NO: 1406 - protein, 5 aa, Artificial Sequence
  Description of Artificial Sequence: Synthetic peptide
GDMRR

SEQ ID NO: 1407 - protein, 5 aa, Artificial Sequence
  Description of Artificial Sequence: Synthetic peptide
EHLKR

SEQ ID NO: 1408 - protein, 5 aa, Artificial Sequence
  Description of Artificial Sequence: Synthetic peptide
DHMKK

SEQ ID NO: 1409 - protein, 5 aa, Artificial Sequence
  Description of Artificial Sequence: Synthetic peptide
GDIDR

SEQ ID NO: 1410 - protein, 5 aa, Artificial Sequence
  Description of Artificial Sequence: Synthetic peptide
GHMKK

SEQ ID NO: 1411 - protein, 5 aa, Artificial Sequence
  Description of Artificial Sequence: Synthetic peptide
TQMMI

SEQ ID NO: 1412 - protein, 5 aa, Artificial Sequence
  Description of Artificial Sequence: Synthetic peptide
SGMKA

SEQ ID NO: 1413 - protein, 5 aa, Artificial Sequence
  Description of Artificial Sequence: Synthetic peptide
TPMRM

SEQ ID NO: 1414 - protein, 5 aa, Artificial Sequence
  Description of Artificial Sequence: Synthetic peptide
SPMKG

SEQ ID NO: 1415 - protein, 5 aa, Artificial Sequence
  Description of Artificial Sequence: Synthetic peptide
KQLNR

SEQ ID NO: 1416 - protein, 5 aa, Artificial Sequence
  Description of Artificial Sequence: Synthetic peptide
NHMKT

SEQ ID NO: 1417 - protein, 5 aa, Artificial Sequence
  Description of Artificial Sequence: Synthetic peptide
TKMRE

SEQ ID NO: 1418 - protein, 5 aa, Artificial Sequence
  Description of Artificial Sequence: Synthetic peptide
EHMAV

SEQ ID NO: 1419 - protein, 5 aa, Artificial Sequence
  Description of Artificial Sequence: Synthetic peptide
EHMNS

SEQ ID NO: 1420 - protein, 5 aa, Artificial Sequence
  Description of Artificial Sequence: Synthetic peptide
DHMHR

SEQ ID NO: 1421 - protein, 5 aa, Artificial Sequence
  Description of Artificial Sequence: Synthetic peptide
AHMVR

SEQ ID NO: 1422 - protein, 5 aa, Artificial Sequence
  Description of Artificial Sequence: Synthetic peptide
GRMRR

SEQ ID NO: 1423 - protein, 5 aa, Artificial Sequence
  Description of Artificial Sequence: Synthetic peptide
GHMNV

SEQ ID NO: 1424 - protein, 5 aa, Artificial Sequence
  Description of Artificial Sequence: Synthetic peptide
GHMNL

SEQ ID NO: 1425 - protein, 5 aa, Artificial Sequence
  Description of Artificial Sequence: Synthetic peptide
GHVSR

SEQ ID NO: 1426 - protein, 5 aa, Artificial Sequence
  Description of Artificial Sequence: Synthetic peptide
GQMHR

SEQ ID NO: 1427 - protein, 5 aa, Artificial Sequence
  Description of Artificial Sequence: Synthetic peptide
EKMAR

SEQ ID NO: 1428 - protein, 5 aa, Artificial Sequence
  Description of Artificial Sequence: Synthetic peptide
NHMGL

SEQ ID NO: 1429 - protein, 5 aa, Artificial Sequence
  Description of Artificial Sequence: Synthetic peptide
EHMKG

SEQ ID NO: 1430 - protein, 5 aa, Artificial Sequence
  Description of Artificial Sequence: Synthetic peptide
EPMAL

SEQ ID NO: 1431 - protein, 5 aa, Artificial Sequence
  Description of Artificial Sequence: Synthetic peptide
AHLTR

SEQ ID NO: 1432 - protein, 5 aa, Artificial Sequence
  Description of Artificial Sequence: Synthetic peptide
KHMTR

SEQ ID NO: 1433 - protein, 5 aa, Artificial Sequence
  Description of Artificial Sequence: Synthetic peptide
GHMTM

SEQ ID NO: 1434 - protein, 5 aa, Artificial Sequence
  Description of Artificial Sequence: Synthetic peptide
EPMSG

SEQ ID NO: 1435 - protein, 5 aa, Artificial Sequence
  Description of Artificial Sequence: Synthetic peptide
NHMNM

SEQ ID NO: 1436 - protein, 5 aa, Artificial Sequence
  Description of Artificial Sequence: Synthetic peptide
GQMKR

SEQ ID NO: 1437 - protein, 5 aa, Artificial Sequence
  Description of Artificial Sequence: Synthetic peptide
TPMEG

SEQ ID NO: 1438 - protein, 5 aa, Artificial Sequence
  Description of Artificial Sequence: Synthetic peptide
KHMRV

SEQ ID NO: 1439 - protein, 5 aa, Artificial Sequence
  Description of Artificial Sequence: Synthetic peptide
SLMKR

SEQ ID NO: 1440 - protein, 5 aa, Artificial Sequence
  Description of Artificial Sequence: Synthetic peptide
DGMRN

SEQ ID NO: 1441 - protein, 5 aa, Artificial Sequence
  Description of Artificial Sequence: Synthetic peptide
RQMHI

SEQ ID NO: 1442 - protein, 5 aa, Artificial Sequence
  Description of Artificial Sequence: Synthetic peptide
EPMRV

SEQ ID NO: 1443 - protein, 5 aa, Artificial Sequence
  Description of Artificial Sequence: Synthetic peptide
SHMRM

SEQ ID NO: 1444 - protein, 5 aa, Artificial Sequence
  Description of Artificial Sequence: Synthetic peptide
EQMAR

SEQ ID NO: 1445 - protein, 5 aa, Artificial Sequence
  Description of Artificial Sequence: Synthetic peptide
SHMRS

SEQ ID NO: 1446 - protein, 5 aa, Artificial Sequence
  Description of Artificial Sequence: Synthetic peptide
EHMQV

SEQ ID NO: 1447 - protein, 5 aa, Artificial Sequence
  Description of Artificial Sequence: Synthetic peptide
EPMPM

SEQ ID NO: 1448 - protein, 5 aa, Artificial Sequence
  Description of Artificial Sequence: Synthetic peptide
IDMNR

SEQ ID NO: 1449 - protein, 5 aa, Artificial Sequence
  Description of Artificial Sequence: Synthetic peptide
TKMKQ

SEQ ID NO: 1450 - protein, 5 aa, Artificial Sequence
  Description of Artificial Sequence: Synthetic peptide
RQMLS

SEQ ID NO: 1451 - protein, 5 aa, Artificial Sequence
  Description of Artificial Sequence: Synthetic peptide
ATMML

SEQ ID NO: 1452 - protein, 5 aa, Artificial Sequence
  Description of Artificial Sequence: Synthetic peptide
PQMMI

SEQ ID NO: 1453 - protein, 5 aa, Artificial Sequence
  Description of Artificial Sequence: Synthetic peptide
NAMKI

SEQ ID NO: 1454 - protein, 5 aa, Artificial Sequence
  Description of Artificial Sequence: Synthetic peptide
GHMQS

SEQ ID NO: 1455 - protein, 5 aa, Artificial Sequence
  Description of Artificial Sequence: Synthetic peptide
EAMKK

SEQ ID NO: 1456 - protein, 5 aa, Artificial Sequence
  Description of Artificial Sequence: Synthetic peptide
THMRK

SEQ ID NO: 1457 - protein, 5 aa, Artificial Sequence
  Description of Artificial Sequence: Synthetic peptide
PHMRR

SEQ ID NO: 1458 - protein, 5 aa, Artificial Sequence
  Description of Artificial Sequence: Synthetic peptide
GHMKA

SEQ ID NO: 1459 - protein, 5 aa, Artificial Sequence
  Description of Artificial Sequence: Synthetic peptide
AHMNH

SEQ ID NO: 1460 - protein, 5 aa, Artificial Sequence
  Description of Artificial Sequence: Synthetic peptide
EYMSR

SEQ ID NO: 1461 - protein, 5 aa, Artificial Sequence
  Description of Artificial Sequence: Synthetic peptide
EHMAW

SEQ ID NO: 1462 - protein, 5 aa, Artificial Sequence
  Description of Artificial Sequence: Synthetic peptide
NHMGR

SEQ ID NO: 1463 - protein, 5 aa, Artificial Sequence
  Description of Artificial Sequence: Synthetic peptide
GHMKS

SEQ ID NO: 1464 - protein, 5 aa, Artificial Sequence
  Description of Artificial Sequence: Synthetic peptide
EHMRL

SEQ ID NO: 1465 - protein, 5 aa, Artificial Sequence
  Description of Artificial Sequence: Synthetic peptide
ENMTR

SEQ ID NO: 1466 - protein, 5 aa, Artificial Sequence
  Description of Artificial Sequence: Synthetic peptide
QAMRV

SEQ ID NO: 1467 - protein, 5 aa, Artificial Sequence
  Description of Artificial Sequence: Synthetic peptide
EHMQP

SEQ ID NO: 1468 - protein, 5 aa, Artificial Sequence
  Description of Artificial Sequence: Synthetic peptide
THMSM

SEQ ID NO: 1469 - protein, 5 aa, Artificial Sequence
  Description of Artificial Sequence: Synthetic peptide
IDMKE

SEQ ID NO: 1470 - protein, 4 aa, Artificial Sequence
  Description of Artificial Sequence: Synthetic peptide
VKES

SEQ ID NO: 1471 - protein, 4 aa, Artificial Sequence
  Description of Artificial Sequence: Synthetic peptide
LRDS

SEQ ID NO: 1472 - protein, 4 aa, Artificial Sequence
  Description of Artificial Sequence: Synthetic peptide
HLES

SEQ ID NO: 1473 - protein, 4 aa, Artificial Sequence
  Description of Artificial Sequence: Synthetic peptide
TRES

SEQ ID NO: 1474 - protein, 4 aa, Artificial Sequence
  Description of Artificial Sequence: Synthetic peptide
MREA

SEQ ID NO: 1475 - protein, 4 aa, Artificial Sequence
  Description of Artificial Sequence: Synthetic peptide
VRET

SEQ ID NO: 1476 - protein, 4 aa, Artificial Sequence
  Description of Artificial Sequence: Synthetic peptide
MRET

SEQ ID NO: 1477 - protein, 4 aa, Artificial Sequence
  Description of Artificial Sequence: Synthetic peptide
LLES

SEQ ID NO: 1478 - protein, 4 aa, Artificial Sequence
  Description of Artificial Sequence: Synthetic peptide
MRTS

SEQ ID NO: 1479 - protein, 4 aa, Artificial Sequence
  Description of Artificial Sequence: Synthetic peptide
ERKS

SEQ ID NO: 1480 - protein, 4 aa, Artificial Sequence
  Description of Artificial Sequence: Synthetic peptide
IKES

SEQ ID NO: 1481 - protein, 4 aa, Artificial Sequence
  Description of Artificial Sequence: Synthetic peptide
VRVT

SEQ ID NO: 1482 - protein, 4 aa, Artificial Sequence
  Description of Artificial Sequence: Synthetic peptide
RNES

SEQ ID NO: 1483 - protein, 4 aa, Artificial Sequence
  Description of Artificial Sequence: Synthetic peptide
HVES

SEQ ID NO: 1484 - protein, 4 aa, Artificial Sequence
  Description of Artificial Sequence: Synthetic peptide
LSHT

SEQ ID NO: 1485 - protein, 4 aa, Artificial Sequence
  Description of Artificial Sequence: Synthetic peptide
RPES

SEQ ID NO: 1486 - protein, 4 aa, Artificial Sequence
  Description of Artificial Sequence: Synthetic peptide
SRES

SEQ ID NO: 1487 - protein, 4 aa, Artificial Sequence
  Description of Artificial Sequence: Synthetic peptide
ENKA

SEQ ID NO: 1488 - protein, 4 aa, Artificial Sequence
  Description of Artificial Sequence: Synthetic peptide
TREN

SEQ ID NO: 1489 - protein, 4 aa, Artificial Sequence
  Description of Artificial Sequence: Synthetic peptide
DSPQ

SEQ ID NO: 1490 - protein, 4 aa, Artificial Sequence
  Description of Artificial Sequence: Synthetic peptide
RRES

SEQ ID NO: 1491 - protein, 4 aa, Artificial Sequence
  Description of Artificial Sequence: Synthetic peptide
RGEN

SEQ ID NO: 1492 - protein, 4 aa, Artificial Sequence
  Description of Artificial Sequence: Synthetic peptide
VRES

SEQ ID NO: 1493 - protein, 4 aa, Artificial Sequence
  Description of Artificial Sequence: Synthetic peptide
HRDS

SEQ ID NO: 1494 - protein, 4 aa, Artificial Sequence
  Description of Artificial Sequence: Synthetic peptide
HREA

SEQ ID NO: 1495 - protein, 4 aa, Artificial Sequence
  Description of Artificial Sequence: Synthetic peptide
LRDT

SEQ ID NO: 1496 - protein, 4 aa, Artificial Sequence
  Description of Artificial Sequence: Synthetic peptide
RVES

SEQ ID NO: 1497 - protein, 4 aa, Artificial Sequence
  Description of Artificial Sequence: Synthetic peptide
EKKS

SEQ ID NO: 1498 - protein, 4 aa, Artificial Sequence
  Description of Artificial Sequence: Synthetic peptide
GRES

SEQ ID NO: 1499 - protein, 4 aa, Artificial Sequence
  Description of Artificial Sequence: Synthetic peptide
RMES

SEQ ID NO: 1500 - protein, 4 aa, Artificial Sequence
  Description of Artificial Sequence: Synthetic peptide
LRES

SEQ ID NO: 1501 - protein, 4 aa, Artificial Sequence
  Description of Artificial Sequence: Synthetic peptide
RTDN

SEQ ID NO: 1502 - protein, 4 aa, Artificial Sequence
  Description of Artificial Sequence: Synthetic peptide
HADH

SEQ ID NO: 1503 - protein, 4 aa, Artificial Sequence
  Description of Artificial Sequence: Synthetic peptide
VNES

SEQ ID NO: 1504 - protein, 4 aa, Artificial Sequence
  Description of Artificial Sequence: Synthetic peptide
ANES

SEQ ID NO: 1505 - protein, 4 aa, Artificial Sequence
  Description of Artificial Sequence: Synthetic peptide
RNEH

SEQ ID NO: 1506 - protein, 4 aa, Artificial Sequence
  Description of Artificial Sequence: Synthetic peptide
MNET

SEQ ID NO: 1507 - protein, 4 aa, Artificial Sequence
  Description of Artificial Sequence: Synthetic peptide
RLDT

SEQ ID NO: 1508 - protein, 4 aa, Artificial Sequence
  Description of Artificial Sequence: Synthetic peptide
RLET

SEQ ID NO: 1509 - protein, 4 aa, Artificial Sequence
  Description of Artificial Sequence: Synthetic peptide
HRET

SEQ ID NO: 1510 - protein, 4 aa, Artificial Sequence
  Description of Artificial Sequence: Synthetic peptide
NRES

SEQ ID NO: 1511 - protein, 4 aa, Artificial Sequence
  Description of Artificial Sequence: Synthetic peptide
TGEA

SEQ ID NO: 1512 - protein, 4 aa, Artificial Sequence
  Description of Artificial Sequence: Synthetic peptide
TGES

SEQ ID NO: 1513 - protein, 4 aa, Artificial Sequence
  Description of Artificial Sequence: Synthetic peptide
RHET

SEQ ID NO: 1514 - protein, 4 aa, Artificial Sequence
  Description of Artificial Sequence: Synthetic peptide
MRES

SEQ ID NO: 1515 - protein, 4 aa, Artificial Sequence
  Description of Artificial Sequence: Synthetic peptide
LVES

SEQ ID NO: 1516 - protein, 4 aa, Artificial Sequence
  Description of Artificial Sequence: Synthetic peptide
VGSS

SEQ ID NO: 1517 - protein, 4 aa, Artificial Sequence
  Description of Artificial Sequence: Synthetic peptide
RIDT

SEQ ID NO: 1518 - protein, 4 aa, Artificial Sequence
  Description of Artificial Sequence: Synthetic peptide
VREA

SEQ ID NO: 1519 - protein, 4 aa, Artificial Sequence
  Description of Artificial Sequence: Synthetic peptide
HMES

SEQ ID NO: 1520 - protein, 4 aa, Artificial Sequence
  Description of Artificial Sequence: Synthetic peptide
ERKN

SEQ ID NO: 1521 - protein, 4 aa, Artificial Sequence
  Description of Artificial Sequence: Synthetic peptide
RPEA

SEQ ID NO: 1522 - protein, 4 aa, Artificial Sequence
  Description of Artificial Sequence: Synthetic peptide
TPPI

SEQ ID NO: 1523 - protein, 4 aa, Artificial Sequence
  Description of Artificial Sequence: Synthetic peptide
RREA

SEQ ID NO: 1524 - protein, 4 aa, Artificial Sequence
  Description of Artificial Sequence: Synthetic peptide
RQEN

SEQ ID NO: 1525 - protein, 4 aa, Artificial Sequence
  Description of Artificial Sequence: Synthetic peptide
VKDS

SEQ ID NO: 1526 - protein, 4 aa, Artificial Sequence
  Description of Artificial Sequence: Synthetic peptide
RKES

SEQ ID NO: 1527 - protein, 4 aa, Artificial Sequence
  Description of Artificial Sequence: Synthetic peptide
MLGL

SEQ ID NO: 1528 - protein, 4 aa, Artificial Sequence
  Description of Artificial Sequence: Synthetic peptide
DRPN

SEQ ID NO: 1529 - protein, 4 aa, Artificial Sequence
  Description of Artificial Sequence: Synthetic peptide
RKEA

SEQ ID NO: 1530 - protein, 5 aa, Artificial Sequence
  Description of Artificial Sequence: Synthetic peptide
VMLGL

SEQ ID NO: 1531 - protein, 4 aa, Artificial Sequence
  Description of Artificial Sequence: Synthetic peptide
TRDS

SEQ ID NO: 1532 - protein, 4 aa, Artificial Sequence
  Description of Artificial Sequence: Synthetic peptide
HLET

SEQ ID NO: 1533 - protein, 4 aa, Artificial Sequence
  Description of Artificial Sequence: Synthetic peptide
HLDS

SEQ ID NO: 1534 - protein, 4 aa, Artificial Sequence
  Description of Artificial Sequence: Synthetic peptide
PPAT

SEQ ID NO: 1535 - protein, 4 aa, Artificial Sequence
  Description of Artificial Sequence: Synthetic peptide
ENAS

SEQ ID NO: 1536 - protein, 4 aa, Artificial Sequence
  Description of Artificial Sequence: Synthetic peptide
VKET

SEQ ID NO: 1537 - protein, 4 aa, Artificial Sequence
  Description of Artificial Sequence: Synthetic peptide
GREA

SEQ ID NO: 1538 - protein, 4 aa, Artificial Sequence
  Description of Artificial Sequence: Synthetic peptide
TREA

SEQ ID NO: 1539 - protein, 4 aa, Artificial Sequence
  Description of Artificial Sequence: Synthetic peptide
IRDS

SEQ ID NO: 1540 - protein, 4 aa, Artificial Sequence
  Description of Artificial Sequence: Synthetic peptide
MNDS

SEQ ID NO: 1541 - protein, 4 aa, Artificial Sequence
  Description of Artificial Sequence: Synthetic peptide
LLDS

SEQ ID NO: 1542 - protein, 4 aa, Artificial Sequence
  Description of Artificial Sequence: Synthetic peptide
RTES

SEQ ID NO: 1543 - protein, 4 aa, Artificial Sequence
  Description of Artificial Sequence: Synthetic peptide
RPET

SEQ ID NO: 1544 - protein, 4 aa, Artificial Sequence
  Description of Artificial Sequence: Synthetic peptide
IDVH

SEQ ID NO: 1545 - protein, 4 aa, Artificial Sequence
  Description of Artificial Sequence: Synthetic peptide
RTEH

SEQ ID NO: 1546 - protein, 4 aa, Artificial Sequence
  Description of Artificial Sequence: Synthetic peptide
TRET

SEQ ID NO: 1547 - protein, 4 aa, Artificial Sequence
  Description of Artificial Sequence: Synthetic peptide
HGES

SEQ ID NO: 1548 - protein, 4 aa, Artificial Sequence
  Description of Artificial Sequence: Synthetic peptide
TMES

SEQ ID NO: 1549 - protein, 4 aa, Artificial Sequence
  Description of Artificial Sequence: Synthetic peptide
LRVS

SEQ ID NO: 1550 - protein, 4 aa, Artificial Sequence
  Description of Artificial Sequence: Synthetic peptide
PREA

SEQ ID NO: 1551 - protein, 4 aa, Artificial Sequence
  Description of Artificial Sequence: Synthetic peptide
EGKN

SEQ ID NO: 1552 - protein, 4 aa, Artificial Sequence
  Description of Artificial Sequence: Synthetic peptide
TSES

SEQ ID NO: 1553 - protein, 13 aa, Artificial Sequence
  Description of Artificial Sequence: Synthetic peptide
VKFGHIFCVLLNV

SEQ ID NO: 1554 - protein, 4 aa, Artificial Sequence
  Description of Artificial Sequence: Synthetic peptide
YRES

SEQ ID NO: 1555 - protein, 4 aa, Artificial Sequence
  Description of Artificial Sequence: Synthetic peptide
MKES

SEQ ID NO: 1556 - protein, 4 aa, Artificial Sequence
  Description of Artificial Sequence: Synthetic peptide
MNEG

SEQ ID NO: 1557 - protein, 4 aa, Artificial Sequence
  Description of Artificial Sequence: Synthetic peptide
MIES

SEQ ID NO: 1558 - protein, 4 aa, Artificial Sequence
  Description of Artificial Sequence: Synthetic peptide
QRES

SEQ ID NO: 1559 - protein, 4 aa, Artificial Sequence
  Description of Artificial Sequence: Synthetic peptide
MMEA

SEQ ID NO: 1560 - protein, 4 aa, Artificial Sequence
  Description of Artificial Sequence: Synthetic peptide
MNER

SEQ ID NO: 1561 - protein, 4 aa, Artificial Sequence
  Description of Artificial Sequence: Synthetic peptide
RNAS

SEQ ID NO: 1562 - protein, 4 aa, Artificial Sequence
  Description of Artificial Sequence: Synthetic peptide
RTDT

SEQ ID NO: 1563 - protein, 4 aa, Artificial Sequence
  Description of Artificial Sequence: Synthetic peptide
TRVS

SEQ ID NO: 1564 - protein, 4 aa, Artificial Sequence
  Description of Artificial Sequence: Synthetic peptide
TFNV

SEQ ID NO: 1565 - protein, 4 aa, Artificial Sequence
  Description of Artificial Sequence: Synthetic peptide
VRVS

SEQ ID NO: 1566 - protein, 4 aa, Artificial Sequence
  Description of Artificial Sequence: Synthetic peptide
FRDS

SEQ ID NO: 1567 - protein, 4 aa, Artificial Sequence
  Description of Artificial Sequence: Synthetic peptide
IKER

SEQ ID NO: 1568 - protein, 4 aa, Artificial Sequence
  Description of Artificial Sequence: Synthetic peptide
RLEN

SEQ ID NO: 1569 - protein, 4 aa, Artificial Sequence
  Description of Artificial Sequence: Synthetic peptide
IKET

SEQ ID NO: 1570 - protein, 4 aa, Artificial Sequence
  Description of Artificial Sequence: Synthetic peptide
HRVS

SEQ ID NO: 1571 - protein, 4 aa, Artificial Sequence
  Description of Artificial Sequence: Synthetic peptide
DRKG

SEQ ID NO: 1572 - protein, 4 aa, Artificial Sequence
  Description of Artificial Sequence: Synthetic peptide
VKEC

SEQ ID NO: 1573 - protein, 4 aa, Artificial Sequence
  Description of Artificial Sequence: Synthetic peptide
MSEA

SEQ ID NO: 1574 - protein, 4 aa, Artificial Sequence
  Description of Artificial Sequence: Synthetic peptide
LRDR

SEQ ID NO: 1575 - protein, 4 aa, Artificial Sequence
  Description of Artificial Sequence: Synthetic peptide
INES

SEQ ID NO: 1576 - protein, 4 aa, Artificial Sequence
  Description of Artificial Sequence: Synthetic peptide
MSES

SEQ ID NO: 1577 - protein, 4 aa, Artificial Sequence
  Description of Artificial Sequence: Synthetic peptide
NLES

SEQ ID NO: 1578 - protein, 4 aa, Artificial Sequence
  Description of Artificial Sequence: Synthetic peptide
LQDS

SEQ ID NO: 1579 - protein, 4 aa, Artificial Sequence
  Description of Artificial Sequence: Synthetic peptide
HAPT

SEQ ID NO: 1580 - protein, 4 aa, Artificial Sequence
  Description of Artificial Sequence: Synthetic peptide
HRKA

SEQ ID NO: 1581 - protein, 4 aa, Artificial Sequence
  Description of Artificial Sequence: Synthetic peptide
LRGS

SEQ ID NO: 1582 - protein, 4 aa, Artificial Sequence
  Description of Artificial Sequence: Synthetic peptide
QSGT

SEQ ID NO: 1583 - protein, 4 aa, Artificial Sequence
  Description of Artificial Sequence: Synthetic peptide
HQES

SEQ ID NO: 1584 - protein, 4 aa, Artificial Sequence
  Description of Artificial Sequence: Synthetic peptide
ETGS

SEQ ID NO: 1585 - protein, 4 aa, Artificial Sequence
  Description of Artificial Sequence: Synthetic peptide
MLGF

SEQ ID NO: 1586 - protein, 4 aa, Artificial Sequence
  Description of Artificial Sequence: Synthetic peptide
MNGS

SEQ ID NO: 1587 - protein, 4 aa, Artificial Sequence
  Description of Artificial Sequence: Synthetic peptide
MRED

SEQ ID NO: 1588 - protein, 4 aa, Artificial Sequence
  Description of Artificial Sequence: Synthetic peptide
TKES

SEQ ID NO: 1589 - protein, 4 aa, Artificial Sequence
  Description of Artificial Sequence: Synthetic peptide
RPDH

SEQ ID NO: 1590 - protein, 4 aa, Artificial Sequence
  Description of Artificial Sequence: Synthetic peptide
HRGS

SEQ ID NO: 1591 - protein, 4 aa, Artificial Sequence
  Description of Artificial Sequence: Synthetic peptide
GNES

SEQ ID NO: 1592 - protein, 4 aa, Artificial Sequence
  Description of Artificial Sequence: Synthetic peptide
LWDS

SEQ ID NO: 1593 - protein, 4 aa, Artificial Sequence
  Description of Artificial Sequence: Synthetic peptide
MRDS

SEQ ID NO: 1594 - protein, 4 aa, Artificial Sequence
  Description of Artificial Sequence: Synthetic peptide
IHES

SEQ ID NO: 1595 - protein, 4 aa, Artificial Sequence
  Description of Artificial Sequence: Synthetic peptide
LRDG

SEQ ID NO: 1596 - protein, 4 aa, Artificial Sequence
  Description of Artificial Sequence: Synthetic peptide
LRDC

SEQ ID NO: 1597 - protein, 4 aa, Artificial Sequence
  Description of Artificial Sequence: Synthetic peptide
MYES

SEQ ID NO: 1598 - protein, 4 aa, Artificial Sequence
  Description of Artificial Sequence: Synthetic peptide
RPNI

SEQ ID NO: 1599 - protein, 4 aa, Artificial Sequence
  Description of Artificial Sequence: Synthetic peptide
EGRS

SEQ ID NO: 1600 - protein, 4 aa, Artificial Sequence
  Description of Artificial Sequence: Synthetic peptide
RLES

SEQ ID NO: 1601 - protein, 7 aa, Artificial Sequence
  Description of Artificial Sequence: Synthetic peptide
LGLPTGR

SEQ ID NO: 1602 - protein, 4 aa, Artificial Sequence
  Description of Artificial Sequence: Synthetic peptide
ARES

SEQ ID NO: 1603 - protein, 4 aa, Artificial Sequence
  Description of Artificial Sequence: Synthetic peptide
HLGS

SEQ ID NO: 1604 - protein, 4 aa, Artificial Sequence
  Description of Artificial Sequence: Synthetic peptide
HSES

SEQ ID NO: 1605 - protein, 4 aa, Artificial Sequence
  Description of Artificial Sequence: Synthetic peptide
PRTS

SEQ ID NO: 1606 - protein, 4 aa, Artificial Sequence
  Description of Artificial Sequence: Synthetic peptide
MNKS

SEQ ID NO: 1607 - protein, 4 aa, Artificial Sequence
  Description of Artificial Sequence: Synthetic peptide
RRDS

SEQ ID NO: 1608 - protein, 4 aa, Artificial Sequence
  Description of Artificial Sequence: Synthetic peptide
RREN

SEQ ID NO: 1609 - protein, 4 aa, Artificial Sequence
  Description of Artificial Sequence: Synthetic peptide
QGES

SEQ ID NO: 1610 - protein, 4 aa, Artificial Sequence
  Description of Artificial Sequence: Synthetic peptide
LREA

SEQ ID NO: 1611 - protein, 4 aa, Artificial Sequence
  Description of Artificial Sequence: Synthetic peptide
LLET

SEQ ID NO: 1612 - protein, 4 aa, Artificial Sequence
  Description of Artificial Sequence: Synthetic peptide
MREV

SEQ ID NO: 1613 - protein, 4 aa, Artificial Sequence
  Description of Artificial Sequence: Synthetic peptide
VEES

SEQ ID NO: 1614 - protein, 4 aa, Artificial Sequence
  Description of Artificial Sequence: Synthetic peptide
MNEA

SEQ ID NO: 1615 - protein, 4 aa, Artificial Sequence
  Description of Artificial Sequence: Synthetic peptide
RNEN

SEQ ID NO: 1616 - protein, 4 aa, Artificial Sequence
  Description of Artificial Sequence: Synthetic peptide
HWES

SEQ ID NO: 1617 - protein, 4 aa, Artificial Sequence
  Description of Artificial Sequence: Synthetic peptide
RHEA

SEQ ID NO: 1618 - protein, 4 aa, Artificial Sequence
  Description of Artificial Sequence: Synthetic peptide
MTES

SEQ ID NO: 1619 - protein, 4 aa, Artificial Sequence
  Description of Artificial Sequence: Synthetic peptide
GRDS

SEQ ID NO: 1620 - protein, 4 aa, Artificial Sequence
  Description of Artificial Sequence: Synthetic peptide
VSET

SEQ ID NO: 1621 - protein, 4 aa, Artificial Sequence
  Description of Artificial Sequence: Synthetic peptide
MRKA

SEQ ID NO: 1622 - protein, 4 aa, Artificial Sequence
  Description of Artificial Sequence: Synthetic peptide
FKES

SEQ ID NO: 1623 - protein, 4 aa, Artificial Sequence
  Description of Artificial Sequence: Synthetic peptide
ERKG

SEQ ID NO: 1624 - protein, 4 aa, Artificial Sequence
  Description of Artificial Sequence: Synthetic peptide
RNDH

SEQ ID NO: 1625 - protein, 4 aa, Artificial Sequence
  Description of Artificial Sequence: Synthetic peptide
VPDA

SEQ ID NO: 1626 - protein, 4 aa, Artificial Sequence
  Description of Artificial Sequence: Synthetic peptide
RKDA

SEQ ID NO: 1627 - protein, 4 aa, Artificial Sequence
  Description of Artificial Sequence: Synthetic peptide
SPDT

SEQ ID NO: 1628 - protein, 4 aa, Artificial Sequence
  Description of Artificial Sequence: Synthetic peptide
TTTL

SEQ ID NO: 1629 - protein, 4 aa, Artificial Sequence
  Description of Artificial Sequence: Synthetic peptide
RKDS

SEQ ID NO: 1630 - protein, 4 aa, Artificial Sequence
  Description of Artificial Sequence: Synthetic peptide
RRLT

SEQ ID NO: 1631 - protein, 4 aa, Artificial Sequence
  Description of Artificial Sequence: Synthetic peptide
RTSN

SEQ ID NO: 1632 - protein, 4 aa, Artificial Sequence
  Description of Artificial Sequence: Synthetic peptide
RQSA

SEQ ID NO: 1633 - protein, 4 aa, Artificial Sequence
  Description of Artificial Sequence: Synthetic peptide
ARFT

SEQ ID NO: 1634 - protein, 4 aa, Artificial Sequence
  Description of Artificial Sequence: Synthetic peptide
DRKS

SEQ ID NO: 1635 - protein, 4 aa, Artificial Sequence
  Description of Artificial Sequence: Synthetic peptide
RMDS

SEQ ID NO: 1636 - protein, 4 aa, Artificial Sequence
  Description of Artificial Sequence: Synthetic peptide
HRKS

SEQ ID NO: 1637 - protein, 4 aa, Artificial Sequence
  Description of Artificial Sequence: Synthetic peptide
GTTP

SEQ ID NO: 1638 - protein, 4 aa, Artificial Sequence
  Description of Artificial Sequence: Synthetic peptide
DKRN

SEQ ID NO: 1639 - protein, 5 aa, Artificial Sequence
  Description of Artificial Sequence: Synthetic peptide
RPERE

SEQ ID NO: 1640 - protein, 4 aa, Artificial Sequence
  Description of Artificial Sequence: Synthetic peptide
SGDS

SEQ ID NO: 1641 - protein, 4 aa, Artificial Sequence
  Description of Artificial Sequence: Synthetic peptide
RGSA

SEQ ID NO: 1642 - protein, 4 aa, Artificial Sequence
  Description of Artificial Sequence: Synthetic peptide
RLDP

SEQ ID NO: 1643 - protein, 4 aa, Artificial Sequence
  Description of Artificial Sequence: Synthetic peptide
RRET

SEQ ID NO: 1644 - protein, 4 aa, Artificial Sequence
  Description of Artificial Sequence: Synthetic peptide
RADT

SEQ ID NO: 1645 - protein, 4 aa, Artificial Sequence
  Description of Artificial Sequence: Synthetic peptide
RKET

SEQ ID NO: 1646 - protein, 4 aa, Artificial Sequence
  Description of Artificial Sequence: Synthetic peptide
ATNM

SEQ ID NO: 1647 - protein, 4 aa, Artificial Sequence
  Description of Artificial Sequence: Synthetic peptide
RREH

SEQ ID NO: 1648 - protein, 4 aa, Artificial Sequence
  Description of Artificial Sequence: Synthetic peptide
RTDH

SEQ ID NO: 1649 - protein, 4 aa, Artificial Sequence
  Description of Artificial Sequence: Synthetic peptide
RNET

SEQ ID NO: 1650 - protein, 4 aa, Artificial Sequence
  Description of Artificial Sequence: Synthetic peptide
RPDN

SEQ ID NO: 1651 - protein, 4 aa, Artificial Sequence
  Description of Artificial Sequence: Synthetic peptide
THVP

SEQ ID NO: 1652 - protein, 4 aa, Artificial Sequence
  Description of Artificial Sequence: Synthetic peptide
EASN

SEQ ID NO: 1653 - protein, 4 aa, Artificial Sequence
  Description of Artificial Sequence: Synthetic peptide
RMEG

SEQ ID NO: 1654 - protein, 4 aa, Artificial Sequence
  Description of Artificial Sequence: Synthetic peptide
RTAA

SEQ ID NO: 1655 - protein, 4 aa, Artificial Sequence
  Description of Artificial Sequence: Synthetic peptide
RNEP

SEQ ID NO: 1656 - protein, 4 aa, Artificial Sequence
  Description of Artificial Sequence: Synthetic peptide
VHDN

SEQ ID NO: 1657 - protein, 4 aa, Artificial Sequence
  Description of Artificial Sequence: Synthetic peptide
RKEN

SEQ ID NO: 1658 - protein, 4 aa, Artificial Sequence
  Description of Artificial Sequence: Synthetic peptide
RPYT

SEQ ID NO: 1659 - protein, 4 aa, Artificial Sequence
  Description of Artificial Sequence: Synthetic peptide
RQES

SEQ ID NO: 1660 - protein, 4 aa, Artificial Sequence
  Description of Artificial Sequence: Synthetic peptide
RSGS

SEQ ID NO: 1661 - protein, 4 aa, Artificial Sequence
  Description of Artificial Sequence: Synthetic peptide
RPDS

SEQ ID NO: 1662 - protein, 4 aa, Artificial Sequence
  Description of Artificial Sequence: Synthetic peptide
MTGN

SEQ ID NO: 1663 - protein, 4 aa, Artificial Sequence
  Description of Artificial Sequence: Synthetic peptide
RGET

SEQ ID NO: 1664 - protein, 4 aa, Artificial Sequence
  Description of Artificial Sequence: Synthetic peptide
RKGS

SEQ ID NO: 1665 - protein, 4 aa, Artificial Sequence
  Description of Artificial Sequence: Synthetic peptide
RNDS

SEQ ID NO: 1666 - protein, 4 aa, Artificial Sequence
  Description of Artificial Sequence: Synthetic peptide
STET

SEQ ID NO: 1667 - protein, 4 aa, Artificial Sequence
  Description of Artificial Sequence: Synthetic peptide
SNES

SEQ ID NO: 1668 - protein, 4 aa, Artificial Sequence
  Description of Artificial Sequence: Synthetic peptide
RPDA

SEQ ID NO: 1669 - protein, 4 aa, Artificial Sequence
  Description of Artificial Sequence: Synthetic peptide
RNER

SEQ ID NO: 1670 - protein, 4 aa, Artificial Sequence
  Description of Artificial Sequence: Synthetic peptide
RPEN

SEQ ID NO: 1671 - protein, 4 aa, Artificial Sequence
  Description of Artificial Sequence: Synthetic peptide
RVET

SEQ ID NO: 1672 - protein, 4 aa, Artificial Sequence
  Description of Artificial Sequence: Synthetic peptide
RAET

SEQ ID NO: 1673 - protein, 4 aa, Artificial Sequence
  Description of Artificial Sequence: Synthetic peptide
SHET

SEQ ID NO: 1674 - protein, 4 aa, Artificial Sequence
  Description of Artificial Sequence: Synthetic peptide
RSDT

SEQ ID NO: 1675 - protein, 4 aa, Artificial Sequence
  Description of Artificial Sequence: Synthetic peptide
LPDT

SEQ ID NO: 1676 - protein, 4 aa, Artificial Sequence
  Description of Artificial Sequence: Synthetic peptide
MMES

SEQ ID NO: 1677 - protein, 4 aa, Artificial Sequence
  Description of Artificial Sequence: Synthetic peptide
SPES

SEQ ID NO: 1678 - protein, 4 aa, Artificial Sequence
  Description of Artificial Sequence: Synthetic peptide
RMEN

SEQ ID NO: 1679 - protein, 4 aa, Artificial Sequence
  Description of Artificial Sequence: Synthetic peptide
RVEI

SEQ ID NO: 1680 - protein, 4 aa, Artificial Sequence
  Description of Artificial Sequence: Synthetic peptide
RMET

SEQ ID NO: 1681 - protein, 4 aa, Artificial Sequence
  Description of Artificial Sequence: Synthetic peptide
SADN

SEQ ID NO: 1682 - protein, 4 aa, Artificial Sequence
  Description of Artificial Sequence: Synthetic peptide
RAES

SEQ ID NO: 1683 - protein, 4 aa, Artificial Sequence
  Description of Artificial Sequence: Synthetic peptide
RPDV

SEQ ID NO: 1684 - protein, 4 aa, Artificial Sequence
  Description of Artificial Sequence: Synthetic peptide
RTEA

SEQ ID NO: 1685 - protein, 4 aa, Artificial Sequence
  Description of Artificial Sequence: Synthetic peptide
RHES

SEQ ID NO: 1686 - protein, 4 aa, Artificial Sequence
  Description of Artificial Sequence: Synthetic peptide
RQEA

SEQ ID NO: 1687 - protein, 4 aa, Artificial Sequence
  Description of Artificial Sequence: Synthetic peptide
RNRS

SEQ ID NO: 1688 - protein, 4 aa, Artificial Sequence
  Description of Artificial Sequence: Synthetic peptide
RAEA

SEQ ID NO: 1689 - protein, 4 aa, Artificial Sequence
  Description of Artificial Sequence: Synthetic peptide
RVDN

SEQ ID NO: 1690 - protein, 4 aa, Artificial Sequence
  Description of Artificial Sequence: Synthetic peptide
RNEG

SEQ ID NO: 1691 - protein, 4 aa, Artificial Sequence
  Description of Artificial Sequence: Synthetic peptide
RVEG

SEQ ID NO: 1692 - protein, 4 aa, Artificial Sequence
  Description of Artificial Sequence: Synthetic peptide
RAEN

SEQ ID NO: 1693 - protein, 4 aa, Artificial Sequence
  Description of Artificial Sequence: Synthetic peptide
RVDT

SEQ ID NO: 1694 - protein, 4 aa, Artificial Sequence
  Description of Artificial Sequence: Synthetic peptide
RDDN

SEQ ID NO: 1695 - protein, 4 aa, Artificial Sequence
  Description of Artificial Sequence: Synthetic peptide
RLEA

SEQ ID NO: 1696 - protein, 4 aa, Artificial Sequence
  Description of Artificial Sequence: Synthetic peptide
RPNT

SEQ ID NO: 1697 - protein, 4 aa, Artificial Sequence
  Description of Artificial Sequence: Synthetic peptide
RGES

SEQ ID NO: 1698 - protein, 4 aa, Artificial Sequence
  Description of Artificial Sequence: Synthetic peptide
SPEA

SEQ ID NO: 1699 - protein, 4 aa, Artificial Sequence
  Description of Artificial Sequence: Synthetic peptide
RTAG

SEQ ID NO: 1700 - protein, 4 aa, Artificial Sequence
  Description of Artificial Sequence: Synthetic peptide
MKEA

SEQ ID NO: 1701 - protein, 4 aa, Artificial Sequence
  Description of Artificial Sequence: Synthetic peptide
WNES

SEQ ID NO: 1702 - protein, 4 aa, Artificial Sequence
  Description of Artificial Sequence: Synthetic peptide
RVEN

SEQ ID NO: 1703 - protein, 4 aa, Artificial Sequence
  Description of Artificial Sequence: Synthetic peptide
RMEH

SEQ ID NO: 1704 - protein, 4 aa, Artificial Sequence
  Description of Artificial Sequence: Synthetic peptide
RKEH

SEQ ID NO: 1705 - protein, 4 aa, Artificial Sequence
  Description of Artificial Sequence: Synthetic peptide
ENRS

SEQ ID NO: 1706 - protein, 4 aa, Artificial Sequence
  Description of Artificial Sequence: Synthetic peptide
RNKS

SEQ ID NO: 1707 - protein, 4 aa, Artificial Sequence
  Description of Artificial Sequence: Synthetic peptide
RPGE

SEQ ID NO: 1708 - protein, 4 aa, Artificial Sequence
  Description of Artificial Sequence: Synthetic peptide
RKDT

SEQ ID NO: 1709 - protein, 4 aa, Artificial Sequence
  Description of Artificial Sequence: Synthetic peptide
RGEA

SEQ ID NO: 1710 - protein, 4 aa, Artificial Sequence
  Description of Artificial Sequence: Synthetic peptide
WIDT

SEQ ID NO: 1711 - protein, 4 aa, Artificial Sequence
  Description of Artificial Sequence: Synthetic peptide
RNEY

SEQ ID NO: 1712 - protein, 4 aa, Artificial Sequence
  Description of Artificial Sequence: Synthetic peptide
RADI

SEQ ID NO: 1713 - protein, 4 aa, Artificial Sequence
  Description of Artificial Sequence: Synthetic peptide
RADY

SEQ ID NO: 1714 - protein, 4 aa, Artificial Sequence
  Description of Artificial Sequence: Synthetic peptide
RTDD

SEQ ID NO: 1715 - protein, 4 aa, Artificial Sequence
  Description of Artificial Sequence: Synthetic peptide
RVDS

SEQ ID NO: 1716 - protein, 4 aa, Artificial Sequence
  Description of Artificial Sequence: Synthetic peptide
HTET

SEQ ID NO: 1717 - protein, 4 aa, Artificial Sequence
  Description of Artificial Sequence: Synthetic peptide
HTEN

SEQ ID NO: 1718 - protein, 4 aa, Artificial Sequence
  Description of Artificial Sequence: Synthetic peptide
SGEN

SEQ ID NO: 1719 - protein, 4 aa, Artificial Sequence
  Description of Artificial Sequence: Synthetic peptide
RTST

SEQ ID NO: 1720 - protein, 4 aa, Artificial Sequence
  Description of Artificial Sequence: Synthetic peptide
RAGR

SEQ ID NO: 1721 - protein, 4 aa, Artificial Sequence
  Description of Artificial Sequence: Synthetic peptide
SNAS

SEQ ID NO: 1722 - protein, 4 aa, Artificial Sequence
  Description of Artificial Sequence: Synthetic peptide
RPGT

SEQ ID NO: 1723 - protein, 4 aa, Artificial Sequence
  Description of Artificial Sequence: Synthetic peptide
RAEH

SEQ ID NO: 1724 - protein, 4 aa, Artificial Sequence
  Description of Artificial Sequence: Synthetic peptide
MHDT

SEQ ID NO: 1725 - protein, 4 aa, Artificial Sequence
  Description of Artificial Sequence: Synthetic peptide
REDN

SEQ ID NO: 1726 - protein, 4 aa, Artificial Sequence
  Description of Artificial Sequence: Synthetic peptide
REEV

SEQ ID NO: 1727 - protein, 4 aa, Artificial Sequence
  Description of Artificial Sequence: Synthetic peptide
RMEW

SEQ ID NO: 1728 - protein, 4 aa, Artificial Sequence
  Description of Artificial Sequence: Synthetic peptide
RRER

SEQ ID NO: 1729 - protein, 4 aa, Artificial Sequence
  Description of Artificial Sequence: Synthetic peptide
RLDN

SEQ ID NO: 1730 - protein, 4 aa, Artificial Sequence
  Description of Artificial Sequence: Synthetic peptide
MVES

SEQ ID NO: 1731 - protein, 4 aa, Artificial Sequence
  Description of Artificial Sequence: Synthetic peptide
RIPA

SEQ ID NO: 1732 - protein, 4 aa, Artificial Sequence
  Description of Artificial Sequence: Synthetic peptide
RMEA

SEQ ID NO: 1733 - protein, 4 aa, Artificial Sequence
  Description of Artificial Sequence: Synthetic peptide
RHNT

SEQ ID NO: 1734 - protein, 4 aa, Artificial Sequence
  Description of Artificial Sequence: Synthetic peptide
RNSS

SEQ ID NO: 1735 - protein, 4 aa, Artificial Sequence
  Description of Artificial Sequence: Synthetic peptide
LPES

SEQ ID NO: 1736 - protein, 4 aa, Artificial Sequence
  Description of Artificial Sequence: Synthetic peptide
SLDP

SEQ ID NO: 1737 - protein, 4 aa, Artificial Sequence
  Description of Artificial Sequence: Synthetic peptide
STEN

SEQ ID NO: 1738 - protein, 4 aa, Artificial Sequence
  Description of Artificial Sequence: Synthetic peptide
RPKS

SEQ ID NO: 1739 - protein, 4 aa, Artificial Sequence
  Description of Artificial Sequence: Synthetic peptide
MIDT

SEQ ID NO: 1740 - protein, 4 aa, Artificial Sequence
  Description of Artificial Sequence: Synthetic peptide
PPDT

SEQ ID NO: 1741 - protein, 4 aa, Artificial Sequence
  Description of Artificial Sequence: Synthetic peptide
GLDA

SEQ ID NO: 1742 - protein, 5 aa, Artificial Sequence
  Description of Artificial Sequence: Synthetic peptide
RPEGE

SEQ ID NO: 1743 - protein, 4 aa, Artificial Sequence
  Description of Artificial Sequence: Synthetic peptide
RHYT

SEQ ID NO: 1744 - protein, 4 aa, Artificial Sequence
  Description of Artificial Sequence: Synthetic peptide
RTEI

SEQ ID NO: 1745 - protein, 4 aa, Artificial Sequence
  Description of Artificial Sequence: Synthetic peptide
SPEN

SEQ ID NO: 1746 - protein, 4 aa, Artificial Sequence
  Description of Artificial Sequence: Synthetic peptide
RHEN

SEQ ID NO: 1747 - protein, 4 aa, Artificial Sequence
  Description of Artificial Sequence: Synthetic peptide
REDV

SEQ ID NO: 1748 - protein, 4 aa, Artificial Sequence
  Description of Artificial Sequence: Synthetic peptide
RLKT

SEQ ID NO: 1749 - protein, 4 aa, Artificial Sequence
  Description of Artificial Sequence: Synthetic peptide
RIET

SEQ ID NO: 1750 - protein, 4 aa, Artificial Sequence
  Description of Artificial Sequence: Synthetic peptide
RIES

SEQ ID NO: 1751 - protein, 4 aa, Artificial Sequence
  Description of Artificial Sequence: Synthetic peptide
RPDI

SEQ ID NO: 1752 - protein, 4 aa, Artificial Sequence
  Description of Artificial Sequence: Synthetic peptide
MNDT

SEQ ID NO: 1753 - protein, 4 aa, Artificial Sequence
  Description of Artificial Sequence: Synthetic peptide
RLYT

SEQ ID NO: 1754 - protein, 4 aa, Artificial Sequence
  Description of Artificial Sequence: Synthetic peptide
RAYN

SEQ ID NO: 1755 - protein, 4 aa, Artificial Sequence
  Description of Artificial Sequence: Synthetic peptide
RADS

SEQ ID NO: 1756 - protein, 4 aa, Artificial Sequence
  Description of Artificial Sequence: Synthetic peptide
KNES

SEQ ID NO: 1757 - protein, 4 aa, Artificial Sequence
  Description of Artificial Sequence: Synthetic peptide
RVSA

SEQ ID NO: 1758 - protein, 4 aa, Artificial Sequence
  Description of Artificial Sequence: Synthetic peptide
RPED

SEQ ID NO: 1759 - protein, 4 aa, Artificial Sequence
  Description of Artificial Sequence: Synthetic peptide
RGEH

SEQ ID NO: 1760 - protein, 4 aa, Artificial Sequence
  Description of Artificial Sequence: Synthetic peptide
LTET

SEQ ID NO: 1761 - protein, 4 aa, Artificial Sequence
  Description of Artificial Sequence: Synthetic peptide
LADN

SEQ ID NO: 1762 - protein, 4 aa, Artificial Sequence
  Description of Artificial Sequence: Synthetic peptide
RPER

SEQ ID NO: 1763 - protein, 8 aa, Artificial Sequence
  Description of Artificial Sequence: Synthetic peptide
MLGLPGTR

SEQ ID NO: 1764 - protein, 4 aa, Artificial Sequence
  Description of Artificial Sequence: Synthetic peptide
RPDP

SEQ ID NO: 1765 - protein, 4 aa, Artificial Sequence
  Description of Artificial Sequence: Synthetic peptide
QADV

SEQ ID NO: 1766 - protein, 4 aa, Artificial Sequence
  Description of Artificial Sequence: Synthetic peptide
MADV

SEQ ID NO: 1767 - protein, 4 aa, Artificial Sequence
  Description of Artificial Sequence: Synthetic peptide
HTDN

SEQ ID NO: 1768 - protein, 4 aa, Artificial Sequence
  Description of Artificial Sequence: Synthetic peptide
RKEV

SEQ ID NO: 1769 - protein, 4 aa, Artificial Sequence
  Description of Artificial Sequence: Synthetic peptide
RADA

SEQ ID NO: 1770 - protein, 4 aa, Artificial Sequence
  Description of Artificial Sequence: Synthetic peptide
RDAS

SEQ ID NO: 1771 - protein, 4 aa, Artificial Sequence
  Description of Artificial Sequence: Synthetic peptide
MLDT

SEQ ID NO: 1772 - protein, 4 aa, Artificial Sequence
  Description of Artificial Sequence: Synthetic peptide
RPGS

SEQ ID NO: 1773 - protein, 4 aa, Artificial Sequence
  Description of Artificial Sequence: Synthetic peptide
RTEY

SEQ ID NO: 1774 - protein, 4 aa, Artificial Sequence
  Description of Artificial Sequence: Synthetic peptide
SLDT

SEQ ID NO: 1775 - protein, 4 aa, Artificial Sequence
  Description of Artificial Sequence: Synthetic peptide
RWES

SEQ ID NO: 1776 - protein, 4 aa, Artificial Sequence
  Description of Artificial Sequence: Synthetic peptide
ERKA

SEQ ID NO: 1777 - protein, 4 aa, Artificial Sequence
  Description of Artificial Sequence: Synthetic peptide
RIYT

SEQ ID NO: 1778 - protein, 4 aa, Artificial Sequence
  Description of Artificial Sequence: Synthetic peptide
TPVP

SEQ ID NO: 1779 - protein, 4 aa, Artificial Sequence
  Description of Artificial Sequence: Synthetic peptide
RQDA

SEQ ID NO: 1780 - protein, 4 aa, Artificial Sequence
  Description of Artificial Sequence: Synthetic peptide
RMER

SEQ ID NO: 1781 - protein, 4 aa, Artificial Sequence
  Description of Artificial Sequence: Synthetic peptide
VGTV

SEQ ID NO: 1782 - protein, 4 aa, Artificial Sequence
  Description of Artificial Sequence: Synthetic peptide
ERGG

SEQ ID NO: 1783 - protein, 4 aa, Artificial Sequence
  Description of Artificial Sequence: Synthetic peptide
EKGT

SEQ ID NO: 1784 - protein, 4 aa, Artificial Sequence
  Description of Artificial Sequence: Synthetic peptide
ERNS

SEQ ID NO: 1785 - protein, 4 aa, Artificial Sequence
  Description of Artificial Sequence: Synthetic peptide
ENNS

SEQ ID NO: 1786 - protein, 4 aa, Artificial Sequence
  Description of Artificial Sequence: Synthetic peptide
HREN

SEQ ID NO: 1787 - protein, 4 aa, Artificial Sequence
  Description of Artificial Sequence: Synthetic peptide
ERKR

SEQ ID NO: 1788 - protein, 4 aa, Artificial Sequence
  Description of Artificial Sequence: Synthetic peptide
ERKI

SEQ ID NO: 1789 - protein, 4 aa, Artificial Sequence
  Description of Artificial Sequence: Synthetic peptide
ERRS

SEQ ID NO: 1790 - protein, 4 aa, Artificial Sequence
  Description of Artificial Sequence: Synthetic peptide
YSPQ

SEQ ID NO: 1791 - protein, 4 aa, Artificial Sequence
  Description of Artificial Sequence: Synthetic peptide
EGKS

SEQ ID NO: 1792 - protein, 4 aa, Artificial Sequence
  Description of Artificial Sequence: Synthetic peptide
HRER

SEQ ID NO: 1793 - protein, 4 aa, Artificial Sequence
  Description of Artificial Sequence: Synthetic peptide
DRKA

SEQ ID NO: 1794 - protein, 4 aa, Artificial Sequence
  Description of Artificial Sequence: Synthetic peptide
ESGN

SEQ ID NO: 1795 - protein, 4 aa, Artificial Sequence
  Description of Artificial Sequence: Synthetic peptide
ERES

SEQ ID NO: 1796 - protein, 4 aa, Artificial Sequence
  Description of Artificial Sequence: Synthetic peptide
HKES

SEQ ID NO: 1797 - protein, 4 aa, Artificial Sequence
  Description of Artificial Sequence: Synthetic peptide
ESKS

SEQ ID NO: 1798 - protein, 4 aa, Artificial Sequence
  Description of Artificial Sequence: Synthetic peptide
EMKS

SEQ ID NO: 1799 - protein, 4 aa, Artificial Sequence
  Description of Artificial Sequence: Synthetic peptide
KRKS

SEQ ID NO: 1800 - protein, 4 aa, Artificial Sequence
  Description of Artificial Sequence: Synthetic peptide
TGDA

SEQ ID NO: 1801 - protein, 4 aa, Artificial Sequence
  Description of Artificial Sequence: Synthetic peptide
NRKS

SEQ ID NO: 1802 - protein, 4 aa, Artificial Sequence
  Description of Artificial Sequence: Synthetic peptide
EKNS

SEQ ID NO: 1803 - protein, 4 aa, Artificial Sequence
  Description of Artificial Sequence: Synthetic peptide
QGKS

SEQ ID NO: 1804 - protein, 4 aa, Artificial Sequence
  Description of Artificial Sequence: Synthetic peptide
DSTQ

SEQ ID NO: 1805 - protein, 4 aa, Artificial Sequence
  Description of Artificial Sequence: Synthetic peptide
VRKS

SEQ ID NO: 1806 - protein, 4 aa, Artificial Sequence
  Description of Artificial Sequence: Synthetic peptide
ENKV

SEQ ID NO: 1807 - protein, 4 aa, Artificial Sequence
  Description of Artificial Sequence: Synthetic peptide
DIPQ

SEQ ID NO: 1808 - protein, 4 aa, Artificial Sequence
  Description of Artificial Sequence: Synthetic peptide
ERKC

SEQ ID NO: 1809 - protein, 4 aa, Artificial Sequence
  Description of Artificial Sequence: Synthetic peptide
HSPQ

SEQ ID NO: 1810 - protein, 4 aa, Artificial Sequence
  Description of Artificial Sequence: Synthetic peptide
RTAT

SEQ ID NO: 1811 - protein, 4 aa, Artificial Sequence
  Description of Artificial Sequence: Synthetic peptide
TRKS

SEQ ID NO: 1812 - protein, 4 aa, Artificial Sequence
  Description of Artificial Sequence: Synthetic peptide
GRKS

SEQ ID NO: 1813 - protein, 4 aa, Artificial Sequence
  Description of Artificial Sequence: Synthetic peptide
ESKA

SEQ ID NO: 1814 - protein, 4 aa, Artificial Sequence
  Description of Artificial Sequence: Synthetic peptide
EKRN

SEQ ID NO: 1815 - protein, 4 aa, Artificial Sequence
  Description of Artificial Sequence: Synthetic peptide
DSPH

SEQ ID NO: 1816 - protein, 4 aa, Artificial Sequence
  Description of Artificial Sequence: Synthetic peptide
ERNG

SEQ ID NO: 1817 - protein, 4 aa, Artificial Sequence
  Description of Artificial Sequence: Synthetic peptide
VSPQ

SEQ ID NO: 1818 - protein, 4 aa, Artificial Sequence
  Description of Artificial Sequence: Synthetic peptide
EKKC

SEQ ID NO: 1819 - protein, 4 aa, Artificial Sequence
  Description of Artificial Sequence: Synthetic peptide
ERNN

SEQ ID NO: 1820 - protein, 4 aa, Artificial Sequence
  Description of Artificial Sequence: Synthetic peptide
TNES

SEQ ID NO: 1821 - protein, 4 aa, Artificial Sequence
  Description of Artificial Sequence: Synthetic peptide
HRKN

SEQ ID NO: 1822 - protein, 4 aa, Artificial Sequence
  Description of Artificial Sequence: Synthetic peptide
DKSN

SEQ ID NO: 1823 - protein, 4 aa, Artificial Sequence
  Description of Artificial Sequence: Synthetic peptide
DRNS

SEQ ID NO: 1824 - protein, 4 aa, Artificial Sequence
  Description of Artificial Sequence: Synthetic peptide
ERMS

SEQ ID NO: 1825 - protein, 4 aa, Artificial Sequence
  Description of Artificial Sequence: Synthetic peptide
EIAS

SEQ ID NO: 1826 - protein, 4 aa, Artificial Sequence
  Description of Artificial Sequence: Synthetic peptide
HREC

SEQ ID NO: 1827 - protein, 4 aa, Artificial Sequence
  Description of Artificial Sequence: Synthetic peptide
ERKT

SEQ ID NO: 1828 - protein, 4 aa, Artificial Sequence
  Description of Artificial Sequence: Synthetic peptide
ETGN

SEQ ID NO: 1829 - protein, 5 aa, Artificial Sequence
  Description of Artificial Sequence: Synthetic peptide
HRLRE

SEQ ID NO: 1830 - protein, 5 aa, Artificial Sequence
  Description of Artificial Sequence: Synthetic peptide
QRLRE

SEQ ID NO: 1831 - protein, 5 aa, Artificial Sequence
  Description of Artificial Sequence: Synthetic peptide
DALKR

SEQ ID NO: 1832 - protein, 5 aa, Artificial Sequence
  Description of Artificial Sequence: Synthetic peptide
SRLRE

SEQ ID NO: 1833 - protein, 5 aa, Artificial Sequence
  Description of Artificial Sequence: Synthetic peptide
DGLKK

SEQ ID NO: 1834 - protein, 5 aa, Artificial Sequence
  Description of Artificial Sequence: Synthetic peptide
HRLKV

SEQ ID NO: 1835 - protein, 5 aa, Artificial Sequence
  Description of Artificial Sequence: Synthetic peptide
ERLRM

SEQ ID NO: 1836 - protein, 5 aa, Artificial Sequence
  Description of Artificial Sequence: Synthetic peptide
QRLKE

SEQ ID NO: 1837 - protein, 5 aa, Artificial Sequence
  Description of Artificial Sequence: Synthetic peptide
DGLVR

SEQ ID NO: 1838 - protein, 5 aa, Artificial Sequence
  Description of Artificial Sequence: Synthetic peptide
NRLRE

SEQ ID NO: 1839 - protein, 5 aa, Artificial Sequence
  Description of Artificial Sequence: Synthetic peptide
ARLRE

SEQ ID NO: 1840 - protein, 5 aa, Artificial Sequence
  Description of Artificial Sequence: Synthetic peptide
ERLRQ

SEQ ID NO: 1841 - protein, 5 aa, Artificial Sequence
  Description of Artificial Sequence: Synthetic peptide
ARLKE

SEQ ID NO: 1842 - protein, 5 aa, Artificial Sequence
  Description of Artificial Sequence: Synthetic peptide
TRLRD

SEQ ID NO: 1843 - protein, 5 aa, Artificial Sequence
  Description of Artificial Sequence: Synthetic peptide
DGLRR

SEQ ID NO: 1844 - protein, 5 aa, Artificial Sequence
  Description of Artificial Sequence: Synthetic peptide
SRLNE

SEQ ID NO: 1845 - protein, 5 aa, Artificial Sequence
  Description of Artificial Sequence: Synthetic peptide
TGLKV

SEQ ID NO: 1846 - protein, 5 aa, Artificial Sequence
  Description of Artificial Sequence: Synthetic peptide
HRLSE

SEQ ID NO: 1847 - protein, 5 aa, Artificial Sequence
  Description of Artificial Sequence: Synthetic peptide
HRLNE

SEQ ID NO: 1848 - protein, 5 aa, Artificial Sequence
  Description of Artificial Sequence: Synthetic peptide
SHLKV

SEQ ID NO: 1849 - protein, 5 aa, Artificial Sequence
  Description of Artificial Sequence: Synthetic peptide
TTLKV

SEQ ID NO: 1850 - protein, 5 aa, Artificial Sequence
  Description of Artificial Sequence: Synthetic peptide
HRLGE

SEQ ID NO: 1851 - protein, 5 aa, Artificial Sequence
  Description of Artificial Sequence: Synthetic peptide
STLKV

SEQ ID NO: 1852 - protein, 5 aa, Artificial Sequence
  Description of Artificial Sequence: Synthetic peptide
DGLKV

SEQ ID NO: 1853 - protein, 5 aa, Artificial Sequence
  Description of Artificial Sequence: Synthetic peptide
DGLRK

SEQ ID NO: 1854 - protein, 5 aa, Artificial Sequence
  Description of Artificial Sequence: Synthetic peptide
HRLTE

SEQ ID NO: 1855 - protein, 5 aa, Artificial Sequence
  Description of Artificial Sequence: Synthetic peptide
DRLKV

SEQ ID NO: 1856 - protein, 5 aa, Artificial Sequence
  Description of Artificial Sequence: Synthetic peptide
HSLKV

SEQ ID NO: 1857 - protein, 5 aa, Artificial Sequence
  Description of Artificial Sequence: Synthetic peptide
SRLKV

SEQ ID NO: 1858 - protein, 5 aa, Artificial Sequence
  Description of Artificial Sequence: Synthetic peptide
QRLKV

SEQ ID NO: 1859 - protein, 5 aa, Artificial Sequence
  Description of Artificial Sequence: Synthetic peptide
HGLTV

SEQ ID NO: 1860 - protein, 5 aa, Artificial Sequence
  Description of Artificial Sequence: Synthetic peptide
HRLME

SEQ ID NO: 1861 - protein, 5 aa, Artificial Sequence
  Description of Artificial Sequence: Synthetic peptide
RLLPN

SEQ ID NO: 1862 - protein, 5 aa, Artificial Sequence
  Description of Artificial Sequence: Synthetic peptide
ERLKV

SEQ ID NO: 1863 - protein, 5 aa, Artificial Sequence
  Description of Artificial Sequence: Synthetic peptide
NRLRV

SEQ ID NO: 1864 - protein, 5 aa, Artificial Sequence
  Description of Artificial Sequence: Synthetic peptide
TRLKV

SEQ ID NO: 1865 - protein, 5 aa, Artificial Sequence
  Description of Artificial Sequence: Synthetic peptide
DGLKE

SEQ ID NO: 1866 - protein, 5 aa, Artificial Sequence
  Description of Artificial Sequence: Synthetic peptide
HGLRV

SEQ ID NO: 1867 - protein, 5 aa, Artificial Sequence
  Description of Artificial Sequence: Synthetic peptide
SALKT

SEQ ID NO: 1868 - protein, 5 aa, Artificial Sequence
  Description of Artificial Sequence: Synthetic peptide
HRLAE

SEQ ID NO: 1869 - protein, 5 aa, Artificial Sequence
  Description of Artificial Sequence: Synthetic peptide
ERLIS

SEQ ID NO: 1870 - protein, 5 aa, Artificial Sequence
  Description of Artificial Sequence: Synthetic peptide
DGLTR

SEQ ID NO: 1871 - protein, 5 aa, Artificial Sequence
  Description of Artificial Sequence: Synthetic peptide
DALVR

SEQ ID NO: 1872 - protein, 5 aa, Artificial Sequence
  Description of Artificial Sequence: Synthetic peptide
HRLKR

SEQ ID NO: 1873 - protein, 5 aa, Artificial Sequence
  Description of Artificial Sequence: Synthetic peptide
ERLRE

SEQ ID NO: 1874 - protein, 5 aa, Artificial Sequence
  Description of Artificial Sequence: Synthetic peptide
HQLKV

SEQ ID NO: 1875 - protein, 5 aa, Artificial Sequence
  Description of Artificial Sequence: Synthetic peptide
TTLKQ

SEQ ID NO: 1876 - protein, 5 aa, Artificial Sequence
  Description of Artificial Sequence: Synthetic peptide
SRLKR

SEQ ID NO: 1877 - protein, 5 aa, Artificial Sequence
  Description of Artificial Sequence: Synthetic peptide
DRLKQ

SEQ ID NO: 1878 - protein, 5 aa, Artificial Sequence
  Description of Artificial Sequence: Synthetic peptide
HRLRV

SEQ ID NO: 1879 - protein, 5 aa, Artificial Sequence
  Description of Artificial Sequence: Synthetic peptide
TRLKR

SEQ ID NO: 1880 - protein, 5 aa, Artificial Sequence
  Description of Artificial Sequence: Synthetic peptide
TRLNE

SEQ ID NO: 1881 - protein, 5 aa, Artificial Sequence
  Description of Artificial Sequence: Synthetic peptide
NRLKQ

SEQ ID NO: 1882 - protein, 5 aa, Artificial Sequence
  Description of Artificial Sequence: Synthetic peptide
TRLKD

SEQ ID NO: 1883 - protein, 5 aa, Artificial Sequence
  Description of Artificial Sequence: Synthetic peptide
TRLRV

SEQ ID NO: 1884 - protein, 5 aa, Artificial Sequence
  Description of Artificial Sequence: Synthetic peptide
EALKR

SEQ ID NO: 1885 - protein, 5 aa, Artificial Sequence
  Description of Artificial Sequence: Synthetic peptide
HTLKQ

SEQ ID NO: 1886 - protein, 5 aa, Artificial Sequence
  Description of Artificial Sequence: Synthetic peptide
NALKV

SEQ ID NO: 1887 - protein, 5 aa, Artificial Sequence
  Description of Artificial Sequence: Synthetic peptide
SALKV

SEQ ID NO: 1888 - protein, 5 aa, Artificial Sequence
  Description of Artificial Sequence: Synthetic peptide
SRLKD

SEQ ID NO: 1889 - protein, 5 aa, Artificial Sequence
  Description of Artificial Sequence: Synthetic peptide
DGLRE

SEQ ID NO: 1890 - protein, 5 aa, Artificial Sequence
  Description of Artificial Sequence: Synthetic peptide
ERLKE

SEQ ID NO: 1891 - protein, 5 aa, Artificial Sequence
  Description of Artificial Sequence: Synthetic peptide
HKLKV

SEQ ID NO: 1892 - protein, 5 aa, Artificial Sequence
  Description of Artificial Sequence: Synthetic peptide
GTLKV

SEQ ID NO: 1893 - protein, 5 aa, Artificial Sequence
  Description of Artificial Sequence: Synthetic peptide
ERLRR

SEQ ID NO: 1894 - protein, 5 aa, Artificial Sequence
  Description of Artificial Sequence: Synthetic peptide
HALKT

SEQ ID NO: 1895 - protein, 5 aa, Artificial Sequence
  Description of Artificial Sequence: Synthetic peptide
HGLKE

SEQ ID NO: 1896 - protein, 5 aa, Artificial Sequence
  Description of Artificial Sequence: Synthetic peptide
HHLVQ

SEQ ID NO: 1897 - protein, 5 aa, Artificial Sequence
  Description of Artificial Sequence: Synthetic peptide
NGLKV

SEQ ID NO: 1898 - protein, 5 aa, Artificial Sequence
  Description of Artificial Sequence: Synthetic peptide
DALKV

SEQ ID NO: 1899 - protein, 5 aa, Artificial Sequence
  Description of Artificial Sequence: Synthetic peptide
HALKE

SEQ ID NO: 1900 - protein, 5 aa, Artificial Sequence
  Description of Artificial Sequence: Synthetic peptide
HHLKQ

SEQ ID NO: 1901 - protein, 5 aa, Artificial Sequence
  Description of Artificial Sequence: Synthetic peptide
HHLKV

SEQ ID NO: 1902 - protein, 5 aa, Artificial Sequence
  Description of Artificial Sequence: Synthetic peptide
TRLKK

SEQ ID NO: 1903 - protein, 5 aa, Artificial Sequence
  Description of Artificial Sequence: Synthetic peptide
DRLRT

SEQ ID NO: 1904 - protein, 5 aa, Artificial Sequence
  Description of Artificial Sequence: Synthetic peptide
DRLRV

SEQ ID NO: 1905 - protein, 5 aa, Artificial Sequence
  Description of Artificial Sequence: Synthetic peptide
HRLKK

SEQ ID NO: 1906 - protein, 5 aa, Artificial Sequence
  Description of Artificial Sequence: Synthetic peptide
NRLKK

SEQ ID NO: 1907 - protein, 5 aa, Artificial Sequence
  Description of Artificial Sequence: Synthetic peptide
SRLIE

SEQ ID NO: 1908 - protein, 5 aa, Artificial Sequence
  Description of Artificial Sequence: Synthetic peptide
TRLME

SEQ ID NO: 1909 - protein, 5 aa, Artificial Sequence
  Description of Artificial Sequence: Synthetic peptide
ATLKV

SEQ ID NO: 1910 - protein, 5 aa, Artificial Sequence
  Description of Artificial Sequence: Synthetic peptide
HGLVV

SEQ ID NO: 1911 - protein, 5 aa, Artificial Sequence
  Description of Artificial Sequence: Synthetic peptide
HRLRM

SEQ ID NO: 1912 - protein, 5 aa, Artificial Sequence
  Description of Artificial Sequence: Synthetic peptide
HRLRQ

SEQ ID NO: 1913 - protein, 5 aa, Artificial Sequence
  Description of Artificial Sequence: Synthetic peptide
HTLKA

SEQ ID NO: 1914 - protein, 5 aa, Artificial Sequence
  Description of Artificial Sequence: Synthetic peptide
NRLRD

SEQ ID NO: 1915 - protein, 5 aa, Artificial Sequence
  Description of Artificial Sequence: Synthetic peptide
TGLKE

SEQ ID NO: 1916 - protein, 5 aa, Artificial Sequence
  Description of Artificial Sequence: Synthetic peptide
TGLKT

SEQ ID NO: 1917 - protein, 5 aa, Artificial Sequence
  Description of Artificial Sequence: Synthetic peptide
TRLRQ

SEQ ID NO: 1918 - protein, 5 aa, Artificial Sequence
  Description of Artificial Sequence: Synthetic peptide
TTLKI

SEQ ID NO: 1919 - protein, 5 aa, Artificial Sequence
  Description of Artificial Sequence: Synthetic peptide
TTLRV

SEQ ID NO: 1920 - protein, 5 aa, Artificial Sequence
  Description of Artificial Sequence: Synthetic peptide
DRLKE

SEQ ID NO: 1921 - protein, 5 aa, Artificial Sequence
  Description of Artificial Sequence: Synthetic peptide
HRLKA

SEQ ID NO: 1922 - protein, 5 aa, Artificial Sequence
  Description of Artificial Sequence: Synthetic peptide
HRLKD

SEQ ID NO: 1923 - protein, 5 aa, Artificial Sequence
  Description of Artificial Sequence: Synthetic peptide
HSLKE

SEQ ID NO: 1924 - protein, 5 aa, Artificial Sequence
  Description of Artificial Sequence: Synthetic peptide
NRLKI

SEQ ID NO: 1925 - protein, 5 aa, Artificial Sequence
  Description of Artificial Sequence: Synthetic peptide
NRLKR

SEQ ID NO: 1926 - protein, 5 aa, Artificial Sequence
  Description of Artificial Sequence: Synthetic peptide
STLKA

SEQ ID NO: 1927 - protein, 5 aa, Artificial Sequence
  Description of Artificial Sequence: Synthetic peptide
TRLKA

SEQ ID NO: 1928 - protein, 5 aa, Artificial Sequence
  Description of Artificial Sequence: Synthetic peptide
TRLKQ

SEQ ID NO: 1929 - protein, 5 aa, Artificial Sequence
  Description of Artificial Sequence: Synthetic peptide
TRLRR

SEQ ID NO: 1930 - protein, 5 aa, Artificial Sequence
  Description of Artificial Sequence: Synthetic peptide
HALKR

SEQ ID NO: 1931 - protein, 5 aa, Artificial Sequence
  Description of Artificial Sequence: Synthetic peptide
HGLKA

SEQ ID NO: 1932 - protein, 5 aa, Artificial Sequence
  Description of Artificial Sequence: Synthetic peptide
HGLKR

SEQ ID NO: 1933 - protein, 4 aa, Artificial Sequence
  Description of Artificial Sequence: Synthetic peptide
HPEG

SEQ ID NO: 1934 - protein, 4 aa, Artificial Sequence
  Description of Artificial Sequence: Synthetic peptide
HRLK

SEQ ID NO: 1935 - protein, 5 aa, Artificial Sequence
  Description of Artificial Sequence: Synthetic peptide
HRLRK

SEQ ID NO: 1936 - protein, 5 aa, Artificial Sequence
  Description of Artificial Sequence: Synthetic peptide
HTLRV

SEQ ID NO: 1937 - protein, 5 aa, Artificial Sequence
  Description of Artificial Sequence: Synthetic peptide
NTLKQ

SEQ ID NO: 1938 - protein, 5 aa, Artificial Sequence
  Description of Artificial Sequence: Synthetic peptide
QRLRV

SEQ ID NO: 1939 - protein, 5 aa, Artificial Sequence
  Description of Artificial Sequence: Synthetic peptide
SRLME

SEQ ID NO: 1940 - protein, 5 aa, Artificial Sequence
  Description of Artificial Sequence: Synthetic peptide
SRPKE

SEQ ID NO: 1941 - protein, 5 aa, Artificial Sequence
  Description of Artificial Sequence: Synthetic peptide
TQLKV

SEQ ID NO: 1942 - protein, 5 aa, Artificial Sequence
  Description of Artificial Sequence: Synthetic peptide
TRLQE

SEQ ID NO: 1943 - protein, 4 aa, Artificial Sequence
  Description of Artificial Sequence: Synthetic peptide
TRLR

SEQ ID NO: 1944 - protein, 5 aa, Artificial Sequence
  Description of Artificial Sequence: Synthetic peptide
ARLKR

SEQ ID NO: 1945 - protein, 5 aa, Artificial Sequence
  Description of Artificial Sequence: Synthetic peptide
ARLKV

SEQ ID NO: 1946 - protein, 4 aa, Artificial Sequence
  Description of Artificial Sequence: Synthetic peptide
ARLR

SEQ ID NO: 1947 - protein, 5 aa, Artificial Sequence
  Description of Artificial Sequence: Synthetic peptide
ARLRV

SEQ ID NO: 1948 - protein, 5 aa, Artificial Sequence
  Description of Artificial Sequence: Synthetic peptide
ARLVR

SEQ ID NO: 1949 - protein, 5 aa, Artificial Sequence
  Description of Artificial Sequence: Synthetic peptide
DALKK

SEQ ID NO: 1950 - protein, 5 aa, Artificial Sequence
  Description of Artificial Sequence: Synthetic peptide
DALRV

SEQ ID NO: 1951 - protein, 5 aa, Artificial Sequence
  Description of Artificial Sequence: Synthetic peptide
DAPKR

SEQ ID NO: 1952 - protein, 5 aa, Artificial Sequence
  Description of Artificial Sequence: Synthetic peptide
DRLRE

SEQ ID NO: 1953 - protein, 5 aa, Artificial Sequence
  Description of Artificial Sequence: Synthetic peptide
EGLKV

SEQ ID NO: 1954 - protein, 5 aa, Artificial Sequence
  Description of Artificial Sequence: Synthetic peptide
ERLLV

SEQ ID NO: 1955 - protein, 5 aa, Artificial Sequence
  Description of Artificial Sequence: Synthetic peptide
ERLRA

SEQ ID NO: 1956 - protein, 5 aa, Artificial Sequence
  Description of Artificial Sequence: Synthetic peptide
ERMRM

SEQ ID NO: 1957 - protein, 5 aa, Artificial Sequence
  Description of Artificial Sequence: Synthetic peptide
GGLKV

SEQ ID NO: 1958 - protein, 5 aa, Artificial Sequence
  Description of Artificial Sequence: Synthetic peptide
GGLVT

SEQ ID NO: 1959 - protein, 5 aa, Artificial Sequence
  Description of Artificial Sequence: Synthetic peptide
HALRE

SEQ ID NO: 1960 - protein, 5 aa, Artificial Sequence
  Description of Artificial Sequence: Synthetic peptide
HGLRE

SEQ ID NO: 1961 - protein, 5 aa, Artificial Sequence
  Description of Artificial Sequence: Synthetic peptide
HHLKE

SEQ ID NO: 1962 - protein, 5 aa, Artificial Sequence
  Description of Artificial Sequence: Synthetic peptide
HILKA

SEQ ID NO: 1963 - protein, 5 aa, Artificial Sequence
  Description of Artificial Sequence: Synthetic peptide
HRLQE

SEQ ID NO: 1964 - protein, 5 aa, Artificial Sequence
  Description of Artificial Sequence: Synthetic peptide
HRLRR

SEQ ID NO: 1965 - protein, 5 aa, Artificial Sequence
  Description of Artificial Sequence: Synthetic peptide
KRLKE

SEQ ID NO: 1966 - protein, 5 aa, Artificial Sequence
  Description of Artificial Sequence: Synthetic peptide
KTLKQ

SEQ ID NO: 1967 - protein, 5 aa, Artificial Sequence
  Description of Artificial Sequence: Synthetic peptide
NALKE

SEQ ID NO: 1968 - protein, 5 aa, Artificial Sequence
  Description of Artificial Sequence: Synthetic peptide
NRLNE

SEQ ID NO: 1969 - protein, 5 aa, Artificial Sequence
  Description of Artificial Sequence: Synthetic peptide
NTLKV

SEQ ID NO: 1970 - protein, 5 aa, Artificial Sequence
  Description of Artificial Sequence: Synthetic peptide
QRLKR

SEQ ID NO: 1971 - protein, 5 aa, Artificial Sequence
  Description of Artificial Sequence: Synthetic peptide
QRLRQ

SEQ ID NO: 1972 - protein, 5 aa, Artificial Sequence
  Description of Artificial Sequence: Synthetic peptide
QSLIA

SEQ ID NO: 1973 - protein, 5 aa, Artificial Sequence
  Description of Artificial Sequence: Synthetic peptide
QTLKV

SEQ ID NO: 1974 - protein, 5 aa, Artificial Sequence
  Description of Artificial Sequence: Synthetic peptide
RKLRS

SEQ ID NO: 1975 - protein, 5 aa, Artificial Sequence
  Description of Artificial Sequence: Synthetic peptide
RRLRE

SEQ ID NO: 1976 - protein, 5 aa, Artificial Sequence
  Description of Artificial Sequence: Synthetic peptide
SALKE

SEQ ID NO: 1977 - protein, 5 aa, Artificial Sequence
  Description of Artificial Sequence: Synthetic peptide
SRLKK

SEQ ID NO: 1978 - protein, 5 aa, Artificial Sequence
  Description of Artificial Sequence: Synthetic peptide
SRLRK

SEQ ID NO: 1979 - protein, 5 aa, Artificial Sequence
  Description of Artificial Sequence: Synthetic peptide
SRLRV

SEQ ID NO: 1980 - protein, 5 aa, Artificial Sequence
  Description of Artificial Sequence: Synthetic peptide
TMLKE

SEQ ID NO: 1981 - protein, 5 aa, Artificial Sequence
  Description of Artificial Sequence: Synthetic peptide
TRLKG

SEQ ID NO: 1982 - protein, 5 aa, Artificial Sequence
  Description of Artificial Sequence: Synthetic peptide
TRLRM

SEQ ID NO: 1983 - protein, 5 aa, Artificial Sequence
  Description of Artificial Sequence: Synthetic peptide
TRLTE

SEQ ID NO: 1984 - protein, 5 aa, Artificial Sequence
  Description of Artificial Sequence: Synthetic peptide
TRRKE

SEQ ID NO: 1985 - protein, 5 aa, Artificial Sequence
  Description of Artificial Sequence: Synthetic peptide
AALKR

SEQ ID NO: 1986 - protein, 5 aa, Artificial Sequence
  Description of Artificial Sequence: Synthetic peptide
AGLKR

SEQ ID NO: 1987 - protein, 5 aa, Artificial Sequence
  Description of Artificial Sequence: Synthetic peptide
AGLKV

SEQ ID NO: 1988 - protein, 5 aa, Artificial Sequence
  Description of Artificial Sequence: Synthetic peptide
AGLVR

SEQ ID NO: 1989 - protein, 5 aa, Artificial Sequence
  Description of Artificial Sequence: Synthetic peptide
ARLGE

SEQ ID NO: 1990 - protein, 5 aa, Artificial Sequence
  Description of Artificial Sequence: Synthetic peptide
ARLME

SEQ ID NO: 1991 - protein, 5 aa, Artificial Sequence
  Description of Artificial Sequence: Synthetic peptide
ARLNE

SEQ ID NO: 1992 - protein, 5 aa, Artificial Sequence
  Description of Artificial Sequence: Synthetic peptide
ARLRD

SEQ ID NO: 1993 - protein, 5 aa, Artificial Sequence
  Description of Artificial Sequence: Synthetic peptide
ARLRM

SEQ ID NO: 1994 - protein, 5 aa, Artificial Sequence
  Description of Artificial Sequence: Synthetic peptide
CRLKE

SEQ ID NO: 1995 - protein, 5 aa, Artificial Sequence
  Description of Artificial Sequence: Synthetic peptide
DALDR

SEQ ID NO: 1996 - protein, 5 aa, Artificial Sequence
  Description of Artificial Sequence: Synthetic peptide
DALKT

SEQ ID NO: 1997 - protein, 5 aa, Artificial Sequence
  Description of Artificial Sequence: Synthetic peptide
DALKW

SEQ ID NO: 1998 - protein, 5 aa, Artificial Sequence
  Description of Artificial Sequence: Synthetic peptide
DALRK

SEQ ID NO: 1999 - protein, 5 aa, Artificial Sequence
  Description of Artificial Sequence: Synthetic peptide
DALTV

SEQ ID NO: 2000 - protein, 5 aa, Artificial Sequence
  Description of Artificial Sequence: Synthetic peptide
DELKR

SEQ ID NO: 2001 - protein, 5 aa, Artificial Sequence
  Description of Artificial Sequence: Synthetic peptide
DELPG

SEQ ID NO: 2002 - protein, 4 aa, Artificial Sequence
  Description of Artificial Sequence: Synthetic peptide
DGLK

SEQ ID NO: 2003 - protein, 5 aa, Artificial Sequence
  Description of Artificial Sequence: Synthetic peptide
DGLKG

SEQ ID NO: 2004 - protein, 5 aa, Artificial Sequence
  Description of Artificial Sequence: Synthetic peptide
DGLKW

SEQ ID NO: 2005 - protein, 5 aa, Artificial Sequence
  Description of Artificial Sequence: Synthetic peptide
DGLLR

SEQ ID NO: 2006 - protein, 5 aa, Artificial Sequence
  Description of Artificial Sequence: Synthetic peptide
DGLRQ

SEQ ID NO: 2007 - protein, 5 aa, Artificial Sequence
  Description of Artificial Sequence: Synthetic peptide
DGLTV

SEQ ID NO: 2008 - protein, 5 aa, Artificial Sequence
  Description of Artificial Sequence: Synthetic peptide
DGLVW

SEQ ID NO: 2009 - protein, 5 aa, Artificial Sequence
  Description of Artificial Sequence: Synthetic peptide
DKLKQ

SEQ ID NO: 2010 - protein, 5 aa, Artificial Sequence
  Description of Artificial Sequence: Synthetic peptide
DKLRQ

SEQ ID NO: 2011 - protein, 5 aa, Artificial Sequence
  Description of Artificial Sequence: Synthetic peptide
DRLRK

SEQ ID NO: 2012 - protein, 5 aa, Artificial Sequence
  Description of Artificial Sequence: Synthetic peptide
DTHAG

SEQ ID NO: 2013 - protein, 5 aa, Artificial Sequence
  Description of Artificial Sequence: Synthetic peptide
DTLKT

SEQ ID NO: 2014 - protein, 5 aa, Artificial Sequence
  Description of Artificial Sequence: Synthetic peptide
DVLKK

SEQ ID NO: 2015 - protein, 4 aa, Artificial Sequence
  Description of Artificial Sequence: Synthetic peptide
EAAG

SEQ ID NO: 2016 - protein, 5 aa, Artificial Sequence
  Description of Artificial Sequence: Synthetic peptide
EHLRQ

SEQ ID NO: 2017 - protein, 5 aa, Artificial Sequence
  Description of Artificial Sequence: Synthetic peptide
ELLKV

SEQ ID NO: 2018 - protein, 5 aa, Artificial Sequence
  Description of Artificial Sequence: Synthetic peptide
EPLRV

SEQ ID NO: 2019 - protein, 5 aa, Artificial Sequence
  Description of Artificial Sequence: Synthetic peptide
ERLCV

SEQ ID NO: 2020 - protein, 5 aa, Artificial Sequence
  Description of Artificial Sequence: Synthetic peptide
ERLKK

SEQ ID NO: 2021 - protein, 5 aa, Artificial Sequence
  Description of Artificial Sequence: Synthetic peptide
ERLVR

SEQ ID NO: 2022 - protein, 5 aa, Artificial Sequence
  Description of Artificial Sequence: Synthetic peptide
ERLWE

SEQ ID NO: 2023 - protein, 5 aa, Artificial Sequence
  Description of Artificial Sequence: Synthetic peptide
ERPRM

SEQ ID NO: 2024 - protein, 5 aa, Artificial Sequence
  Description of Artificial Sequence: Synthetic peptide
ERPRV

SEQ ID NO: 2025 - protein, 5 aa, Artificial Sequence
  Description of Artificial Sequence: Synthetic peptide
ERQRM

SEQ ID NO: 2026 - protein, 5 aa, Artificial Sequence
  Description of Artificial Sequence: Synthetic peptide
GGLKQ

SEQ ID NO: 2027 - protein, 5 aa, Artificial Sequence
  Description of Artificial Sequence: Synthetic peptide
GGLKR

SEQ ID NO: 2028 - protein, 5 aa, Artificial Sequence
  Description of Artificial Sequence: Synthetic peptide
GMLKV

SEQ ID NO: 2029 - protein, 5 aa, Artificial Sequence
  Description of Artificial Sequence: Synthetic peptide
GRLKE

SEQ ID NO: 2030 - protein, 5 aa, Artificial Sequence
  Description of Artificial Sequence: Synthetic peptide
GTLKQ

SEQ ID NO: 2031 - protein, 5 aa, Artificial Sequence
  Description of Artificial Sequence: Synthetic peptide
HALKA

SEQ ID NO: 2032 - protein, 5 aa, Artificial Sequence
  Description of Artificial Sequence: Synthetic peptide
HALKG

SEQ ID NO: 2033 - protein, 5 aa, Artificial Sequence
  Description of Artificial Sequence: Synthetic peptide
HALPV

SEQ ID NO: 2034 - protein, 5 aa, Artificial Sequence
  Description of Artificial Sequence: Synthetic peptide
HAPEV

SEQ ID NO: 2035 - protein, 5 aa, Artificial Sequence
  Description of Artificial Sequence: Synthetic peptide
HGLKK

SEQ ID NO: 2036 - protein, 5 aa, Artificial Sequence
  Description of Artificial Sequence: Synthetic peptide
HGLKQ

SEQ ID NO: 2037 - protein, 5 aa, Artificial Sequence
  Description of Artificial Sequence: Synthetic peptide
HGLMV

SEQ ID NO: 2038 - protein, 5 aa, Artificial Sequence
  Description of Artificial Sequence: Synthetic peptide
HGLPV

SEQ ID NO: 2039 - protein, 5 aa, Artificial Sequence
  Description of Artificial Sequence: Synthetic peptide
HGLRD

SEQ ID NO: 2040 - protein, 5 aa, Artificial Sequence
  Description of Artificial Sequence: Synthetic peptide
HGQKE

SEQ ID NO: 2041 - protein, 5 aa, Artificial Sequence
  Description of Artificial Sequence: Synthetic peptide
HGRKV

SEQ ID NO: 2042 - protein, 5 aa, Artificial Sequence
  Description of Artificial Sequence: Synthetic peptide
HGRRG

SEQ ID NO: 2043 - protein, 5 aa, Artificial Sequence
  Description of Artificial Sequence: Synthetic peptide
HHLRV

SEQ ID NO: 2044 - protein, 5 aa, Artificial Sequence
  Description of Artificial Sequence: Synthetic peptide
HILIA

SEQ ID NO: 2045 - protein, 5 aa, Artificial Sequence
  Description of Artificial Sequence: Synthetic peptide
HKLKE

SEQ ID NO: 2046 - protein, 5 aa, Artificial Sequence
  Description of Artificial Sequence: Synthetic peptide
HKLRV

SEQ ID NO: 2047 - protein, 5 aa, Artificial Sequence
  Description of Artificial Sequence: Synthetic peptide
HMLKR

SEQ ID NO: 2048 - protein, 5 aa, Artificial Sequence
  Description of Artificial Sequence: Synthetic peptide
HMLRE

SEQ ID NO: 2049 - protein, 5 aa, Artificial Sequence
  Description of Artificial Sequence: Synthetic peptide
HNLKV

SEQ ID NO: 2050 - protein, 5 aa, Artificial Sequence
  Description of Artificial Sequence: Synthetic peptide
HPLKV

SEQ ID NO: 2051 - protein, 5 aa, Artificial Sequence
  Description of Artificial Sequence: Synthetic peptide
HQLKE

SEQ ID NO: 2052 - protein, 5 aa, Artificial Sequence
  Description of Artificial Sequence: Synthetic peptide
HQLRE

SEQ ID NO: 2053 - protein, 5 aa, Artificial Sequence
  Description of Artificial Sequence: Synthetic peptide
HQLRV

SEQ ID NO: 2054 - protein, 5 aa, Artificial Sequence
  Description of Artificial Sequence: Synthetic peptide
HRGCG

SEQ ID NO: 2055 - protein, 5 aa, Artificial Sequence
  Description of Artificial Sequence: Synthetic peptide
HRLDE

SEQ ID NO: 2056 - protein, 5 aa, Artificial Sequence
  Description of Artificial Sequence: Synthetic peptide
HRLIE

SEQ ID NO: 2057 - protein, 5 aa, Artificial Sequence
  Description of Artificial Sequence: Synthetic peptide
HRLKF

SEQ ID NO: 2058 - protein, 5 aa, Artificial Sequence
  Description of Artificial Sequence: Synthetic peptide
HRLKG

SEQ ID NO: 2059 - protein, 5 aa, Artificial Sequence
  Description of Artificial Sequence: Synthetic peptide
HRLKL

SEQ ID NO: 2060 - protein, 5 aa, Artificial Sequence
  Description of Artificial Sequence: Synthetic peptide
HRLMV

SEQ ID NO: 2061 - protein, 4 aa, Artificial Sequence
  Description of Artificial Sequence: Synthetic peptide
HRLN

SEQ ID NO: 2062 - protein, 4 aa, Artificial Sequence
  Description of Artificial Sequence: Synthetic peptide
HRLR

SEQ ID NO: 2063 - protein, 5 aa, Artificial Sequence
  Description of Artificial Sequence: Synthetic peptide
HRLRA

SEQ ID NO: 2064 - protein, 4 aa, Artificial Sequence
  Description of Artificial Sequence: Synthetic peptide
HRLS

SEQ ID NO: 2065 - protein, 5 aa, Artificial Sequence
  Description of Artificial Sequence: Synthetic peptide
HRLVR

SEQ ID NO: 2066 - protein, 5 aa, Artificial Sequence
  Description of Artificial Sequence: Synthetic peptide
HRMRE

SEQ ID NO: 2067 - protein, 5 aa, Artificial Sequence
  Description of Artificial Sequence: Synthetic peptide
HRPKE

SEQ ID NO: 2068 - protein, 5 aa, Artificial Sequence
  Description of Artificial Sequence: Synthetic peptide
HRPNE

SEQ ID NO: 2069 - protein, 5 aa, Artificial Sequence
  Description of Artificial Sequence: Synthetic peptide
HRQRE

SEQ ID NO: 2070 - protein, 5 aa, Artificial Sequence
  Description of Artificial Sequence: Synthetic peptide
HRRKE

SEQ ID NO: 2071 - protein, 5 aa, Artificial Sequence
  Description of Artificial Sequence: Synthetic peptide
HRRME

SEQ ID NO: 2072 - protein, 5 aa, Artificial Sequence
  Description of Artificial Sequence: Synthetic peptide
HRRRE

SEQ ID NO: 2073 - protein, 5 aa, Artificial Sequence
  Description of Artificial Sequence: Synthetic peptide
HRVRE

SEQ ID NO: 2074 - protein, 5 aa, Artificial Sequence
  Description of Artificial Sequence: Synthetic peptide
HSACG

SEQ ID NO: 2075 - protein, 5 aa, Artificial Sequence
  Description of Artificial Sequence: Synthetic peptide
HSLNV

SEQ ID NO: 2076 - protein, 5 aa, Artificial Sequence
  Description of Artificial Sequence: Synthetic peptide
HSLRV

SEQ ID NO: 2077 - protein, 5 aa, Artificial Sequence
  Description of Artificial Sequence: Synthetic peptide
HTLAQ

SEQ ID NO: 2078 - protein, 5 aa, Artificial Sequence
  Description of Artificial Sequence: Synthetic peptide
HTLNV

SEQ ID NO: 2079 - protein, 5 aa, Artificial Sequence
  Description of Artificial Sequence: Synthetic peptide
HTMKV

SEQ ID NO: 2080 - protein, 5 aa, Artificial Sequence
  Description of Artificial Sequence: Synthetic peptide
HVLKV

SEQ ID NO: 2081 - protein, 5 aa, Artificial Sequence
  Description of Artificial Sequence: Synthetic peptide
HWLRE

SEQ ID NO: 2082 - protein, 5 aa, Artificial Sequence
  Description of Artificial Sequence: Synthetic peptide
KGLKQ

SEQ ID NO: 2083 - protein, 5 aa, Artificial Sequence
  Description of Artificial Sequence: Synthetic peptide
MHLRS

SEQ ID NO: 2084 - protein, 5 aa, Artificial Sequence
  Description of Artificial Sequence: Synthetic peptide
MRLRE

SEQ ID NO: 2085 - protein, 5 aa, Artificial Sequence
  Description of Artificial Sequence: Synthetic peptide
MRLRM

SEQ ID NO: 2086 - protein, 5 aa, Artificial Sequence
  Description of Artificial Sequence: Synthetic peptide
NALKR

SEQ ID NO: 2087 - protein, 5 aa, Artificial Sequence
  Description of Artificial Sequence: Synthetic peptide
NGLKE

SEQ ID NO: 2088 - protein, 5 aa, Artificial Sequence
  Description of Artificial Sequence: Synthetic peptide
NLLRE

SEQ ID NO: 2089 - protein, 5 aa, Artificial Sequence
  Description of Artificial Sequence: Synthetic peptide
NMLKE

SEQ ID NO: 2090 - protein, 5 aa, Artificial Sequence
  Description of Artificial Sequence: Synthetic peptide
NMLNV

SEQ ID NO: 2091 - protein, 5 aa, Artificial Sequence
  Description of Artificial Sequence: Synthetic peptide
NPLRE

SEQ ID NO: 2092 - protein, 5 aa, Artificial Sequence
  Description of Artificial Sequence: Synthetic peptide
NRFKE

SEQ ID NO: 2093 - protein, 5 aa, Artificial Sequence
  Description of Artificial Sequence: Synthetic peptide
NRLIE

SEQ ID NO: 2094 - protein, 5 aa, Artificial Sequence
  Description of Artificial Sequence: Synthetic peptide
NRLKA

SEQ ID NO: 2095 - protein, 5 aa, Artificial Sequence
  Description of Artificial Sequence: Synthetic peptide
NRLKF

SEQ ID NO: 2096 - protein, 5 aa, Artificial Sequence
  Description of Artificial Sequence: Synthetic peptide
NRLKL

SEQ ID NO: 2097 - protein, 5 aa, Artificial Sequence
  Description of Artificial Sequence: Synthetic peptide
NRLKT

SEQ ID NO: 2098 - protein, 5 aa, Artificial Sequence
  Description of Artificial Sequence: Synthetic peptide
NRLME

SEQ ID NO: 2099 - protein, 5 aa, Artificial Sequence
  Description of Artificial Sequence: Synthetic peptide
NRLND

SEQ ID NO: 2100 - protein, 5 aa, Artificial Sequence
  Description of Artificial Sequence: Synthetic peptide
NRLNV

SEQ ID NO: 2101 - protein, 5 aa, Artificial Sequence
  Description of Artificial Sequence: Synthetic peptide
NRLQE

SEQ ID NO: 2102 - protein, 4 aa, Artificial Sequence
  Description of Artificial Sequence: Synthetic peptide
NRLR

SEQ ID NO: 2103 - protein, 5 aa, Artificial Sequence
  Description of Artificial Sequence: Synthetic peptide
NRLRM

SEQ ID NO: 2104 - protein, 5 aa, Artificial Sequence
  Description of Artificial Sequence: Synthetic peptide
NRLRQ

SEQ ID NO: 2105 - protein, 5 aa, Artificial Sequence
  Description of Artificial Sequence: Synthetic peptide
NRMKE

SEQ ID NO: 2106 - protein, 5 aa, Artificial Sequence
  Description of Artificial Sequence: Synthetic peptide
NRPKE

SEQ ID NO: 2107 - protein, 5 aa, Artificial Sequence
  Description of Artificial Sequence: Synthetic peptide
NRPKV

SEQ ID NO: 2108 - protein, 5 aa, Artificial Sequence
  Description of Artificial Sequence: Synthetic peptide
NRQKE

SEQ ID NO: 2109 - protein, 5 aa, Artificial Sequence
  Description of Artificial Sequence: Synthetic peptide
NSLKE

SEQ ID NO: 2110 - protein, 5 aa, Artificial Sequence
  Description of Artificial Sequence: Synthetic peptide
NTLTV

SEQ ID NO: 2111 - protein, 5 aa, Artificial Sequence
  Description of Artificial Sequence: Synthetic peptide
PRLKE

SEQ ID NO: 2112 - protein, 5 aa, Artificial Sequence
  Description of Artificial Sequence: Synthetic peptide
PRLLP

SEQ ID NO: 2113 - protein, 5 aa, Artificial Sequence
  Description of Artificial Sequence: Synthetic peptide
PRLRE

SEQ ID NO: 2114 - protein, 5 aa, Artificial Sequence
  Description of Artificial Sequence: Synthetic peptide
PRLTE

SEQ ID NO: 2115 - protein, 4 aa, Artificial Sequence
  Description of Artificial Sequence: Synthetic peptide
QAEG

SEQ ID NO: 2116 - protein, 5 aa, Artificial Sequence
  Description of Artificial Sequence: Synthetic peptide
QRLIS

SEQ ID NO: 2117 - protein, 5 aa, Artificial Sequence
  Description of Artificial Sequence: Synthetic peptide
QRLKK

SEQ ID NO: 2118 - protein, 5 aa, Artificial Sequence
  Description of Artificial Sequence: Synthetic peptide
QRLME

SEQ ID NO: 2119 - protein, 5 aa, Artificial Sequence
  Description of Artificial Sequence: Synthetic peptide
QRLRG

SEQ ID NO: 2120 - protein, 5 aa, Artificial Sequence
  Description of Artificial Sequence: Synthetic peptide
QRLRM

SEQ ID NO: 2121 - protein, 5 aa, Artificial Sequence
  Description of Artificial Sequence: Synthetic peptide
QRLTE

SEQ ID NO: 2122 - protein, 4 aa, Artificial Sequence
  Description of Artificial Sequence: Synthetic peptide
QTAR

SEQ ID NO: 2123 - protein, 4 aa, Artificial Sequence
  Description of Artificial Sequence: Synthetic peptide
QTAW

SEQ ID NO: 2124 - protein, 4 aa, Artificial Sequence
  Description of Artificial Sequence: Synthetic peptide
QTGS

SEQ ID NO: 2125 - protein, 5 aa, Artificial Sequence
  Description of Artificial Sequence: Synthetic peptide
RGLKV

SEQ ID NO: 2126 - protein, 5 aa, Artificial Sequence
  Description of Artificial Sequence: Synthetic peptide
RRLGD

SEQ ID NO: 2127 - protein, 5 aa, Artificial Sequence
  Description of Artificial Sequence: Synthetic peptide
RRLKE

SEQ ID NO: 2128 - protein, 5 aa, Artificial Sequence
  Description of Artificial Sequence: Synthetic peptide
RRLNE

SEQ ID NO: 2129 - protein, 5 aa, Artificial Sequence
  Description of Artificial Sequence: Synthetic peptide
RRLTK

SEQ ID NO: 2130 - protein, 5 aa, Artificial Sequence
  Description of Artificial Sequence: Synthetic peptide
SALKK

SEQ ID NO: 2131 - protein, 5 aa, Artificial Sequence
  Description of Artificial Sequence: Synthetic peptide
SALKR

SEQ ID NO: 2132 - protein, 5 aa, Artificial Sequence
  Description of Artificial Sequence: Synthetic peptide
SCLKE

SEQ ID NO: 2133 - protein, 5 aa, Artificial Sequence
  Description of Artificial Sequence: Synthetic peptide
SGLAM

SEQ ID NO: 2134 - protein, 5 aa, Artificial Sequence
  Description of Artificial Sequence: Synthetic peptide
SGLAV

SEQ ID NO: 2135 - protein, 5 aa, Artificial Sequence
  Description of Artificial Sequence: Synthetic peptide
SGLKV

SEQ ID NO: 2136 - protein, 5 aa, Artificial Sequence
  Description of Artificial Sequence: Synthetic peptide
SHLKE

SEQ ID NO: 2137 - protein, 5 aa, Artificial Sequence
  Description of Artificial Sequence: Synthetic peptide
SKLKV

SEQ ID NO: 2138 - protein, 5 aa, Artificial Sequence
  Description of Artificial Sequence: Synthetic peptide
SQLKV

SEQ ID NO: 2139 - protein, 5 aa, Artificial Sequence
  Description of Artificial Sequence: Synthetic peptide
SRLIG

SEQ ID NO: 2140 - protein, 4 aa, Artificial Sequence
  Description of Artificial Sequence: Synthetic peptide
SRLK

SEQ ID NO: 2141 - protein, 5 aa, Artificial Sequence
  Description of Artificial Sequence: Synthetic peptide
SRLKA

SEQ ID NO: 2142 - protein, 5 aa, Artificial Sequence
  Description of Artificial Sequence: Synthetic peptide
SRLKG

SEQ ID NO: 2143 - protein, 5 aa, Artificial Sequence
  Description of Artificial Sequence: Synthetic peptide
SRLQE

SEQ ID NO: 2144 - protein, 4 aa, Artificial Sequence
  Description of Artificial Sequence: Synthetic peptide
SRLR

SEQ ID NO: 2145 - protein, 5 aa, Artificial Sequence
  Description of Artificial Sequence: Synthetic peptide
SRLRA

SEQ ID NO: 2146 - protein, 5 aa, Artificial Sequence
  Description of Artificial Sequence: Synthetic peptide
SRLRM

SEQ ID NO: 2147 - protein, 5 aa, Artificial Sequence
  Description of Artificial Sequence: Synthetic peptide
SRLRQ

SEQ ID NO: 2148 - protein, 5 aa, Artificial Sequence
  Description of Artificial Sequence: Synthetic peptide
SRLTE

SEQ ID NO: 2149 - protein, 5 aa, Artificial Sequence
  Description of Artificial Sequence: Synthetic peptide
SRQRE

SEQ ID NO: 2150 - protein, 5 aa, Artificial Sequence
  Description of Artificial Sequence: Synthetic peptide
SSLKE

SEQ ID NO: 2151 - protein, 5 aa, Artificial Sequence
  Description of Artificial Sequence: Synthetic peptide
SSLKV

SEQ ID NO: 2152 - protein, 5 aa, Artificial Sequence
  Description of Artificial Sequence: Synthetic peptide
SSQRE

SEQ ID NO: 2153 - protein, 5 aa, Artificial Sequence
  Description of Artificial Sequence: Synthetic peptide
STLKR

SEQ ID NO: 2154 - protein, 5 aa, Artificial Sequence
  Description of Artificial Sequence: Synthetic peptide
TGLKG

SEQ ID NO: 2155 - protein, 5 aa, Artificial Sequence
  Description of Artificial Sequence: Synthetic peptide
TGLKQ

SEQ ID NO: 2156 - protein, 5 aa, Artificial Sequence
  Description of Artificial Sequence: Synthetic peptide
TGLKS

SEQ ID NO: 2157 - protein, 5 aa, Artificial Sequence
  Description of Artificial Sequence: Synthetic peptide
TGLRV

SEQ ID NO: 2158 - protein, 5 aa, Artificial Sequence
  Description of Artificial Sequence: Synthetic peptide
TGRRG

SEQ ID NO: 2159 - protein, 5 aa, Artificial Sequence
  Description of Artificial Sequence: Synthetic peptide
TLLRE

SEQ ID NO: 2160 - protein, 5 aa, Artificial Sequence
  Description of Artificial Sequence: Synthetic peptide
TMQKE

SEQ ID NO: 2161 - protein, 4 aa, Artificial Sequence
  Description of Artificial Sequence: Synthetic peptide
TRLL

SEQ ID NO: 2162 - protein, 5 aa, Artificial Sequence
  Description of Artificial Sequence: Synthetic peptide
TRLAE

SEQ ID NO: 2163 - protein, 4 aa, Artificial Sequence
  Description of Artificial Sequence: Synthetic peptide
TRLE

SEQ ID NO: 2164 - protein, 5 aa, Artificial Sequence
  Description of Artificial Sequence: Synthetic peptide
TRLEE

SEQ ID NO: 2165 - protein, 5 aa, Artificial Sequence
  Description of Artificial Sequence: Synthetic peptide
TRLGE

SEQ ID NO: 2166 - protein, 4 aa, Artificial Sequence
  Description of Artificial Sequence: Synthetic peptide
TRLK

SEQ ID NO: 2167 - protein, 5 aa, Artificial Sequence
  Description of Artificial Sequence: Synthetic peptide
TRLKY

SEQ ID NO: 2168 - protein, 5 aa, Artificial Sequence
  Description of Artificial Sequence: Synthetic peptide
TRLRG

SEQ ID NO: 2169 - protein, 5 aa, Artificial Sequence
  Description of Artificial Sequence: Synthetic peptide
TRLRK

SEQ ID NO: 2170 - protein, 5 aa, Artificial Sequence
  Description of Artificial Sequence: Synthetic peptide
TRLSE

SEQ ID NO: 2171 - protein, 5 aa, Artificial Sequence
  Description of Artificial Sequence: Synthetic peptide
TRPKE

SEQ ID NO: 2172 - protein, 5 aa, Artificial Sequence
  Description of Artificial Sequence: Synthetic peptide
TRQRD

SEQ ID NO: 2173 - protein, 5 aa, Artificial Sequence
  Description of Artificial Sequence: Synthetic peptide
TRRRD

SEQ ID NO: 2174 - protein, 5 aa, Artificial Sequence
  Description of Artificial Sequence: Synthetic peptide
TRVRE

SEQ ID NO: 2175 - protein, 5 aa, Artificial Sequence
  Description of Artificial Sequence: Synthetic peptide
TSLRE

SEQ ID NO: 2176 - protein, 5 aa, Artificial Sequence
  Description of Artificial Sequence: Synthetic peptide
TTLKA

SEQ ID NO: 2177 - protein, 5 aa, Artificial Sequence
  Description of Artificial Sequence: Synthetic peptide
TTLKE

SEQ ID NO: 2178 - protein, 5 aa, Artificial Sequence
  Description of Artificial Sequence: Synthetic peptide
TTLKL

SEQ ID NO: 2179 - protein, 5 aa, Artificial Sequence
  Description of Artificial Sequence: Synthetic peptide
TTLKT

SEQ ID NO: 2180 - protein, 5 aa, Artificial Sequence
  Description of Artificial Sequence: Synthetic peptide
TTPRG

SEQ ID NO: 2181 - protein, 5 aa, Artificial Sequence
  Description of Artificial Sequence: Synthetic peptide
TTRKQ

SEQ ID NO: 2182 - protein, 5 aa, Artificial Sequence
  Description of Artificial Sequence: Synthetic peptide
TWLRE

SEQ ID NO: 2183 - protein, 5 aa, Artificial Sequence
  Description of Artificial Sequence: Synthetic peptide
VRRKV

SEQ ID NO: 2184 - protein, 5 aa, Artificial Sequence
  Description of Artificial Sequence: Synthetic peptide
YGLKR

SEQ ID NO: 2185 - protein, 5 aa, Artificial Sequence
  Description of Artificial Sequence: Synthetic peptide
YRLKE

SEQ ID NO: 2186 - protein, 5 aa, Artificial Sequence
  Description of Artificial Sequence: Synthetic peptide
YTLKV

SEQ ID NO: 2187 - protein, 5 aa, Artificial Sequence
  Description of Artificial Sequence: Synthetic peptide
SKLKE

SEQ ID NO: 2188 - protein, 5 aa, Artificial Sequence
  Description of Artificial Sequence: Synthetic peptide
HILKT

SEQ ID NO: 2189 - protein, 5 aa, Artificial Sequence
  Description of Artificial Sequence: Synthetic peptide
TSLKV

SEQ ID NO: 2190 - protein, 5 aa, Artificial Sequence
  Description of Artificial Sequence: Synthetic peptide
HRLHE

SEQ ID NO: 2191 - protein, 5 aa, Artificial Sequence
  Description of Artificial Sequence: Synthetic peptide
SKLRM

SEQ ID NO: 2192 - protein, 5 aa, Artificial Sequence
  Description of Artificial Sequence: Synthetic peptide
GTLRV

SEQ ID NO: 2193 - protein, 5 aa, Artificial Sequence
  Description of Artificial Sequence: Synthetic peptide
HTLKS

SEQ ID NO: 2194 - protein, 5 aa, Artificial Sequence
  Description of Artificial Sequence: Synthetic peptide
HGLKT

SEQ ID NO: 2195 - protein, 5 aa, Artificial Sequence
  Description of Artificial Sequence: Synthetic peptide
DTLKE

SEQ ID NO: 2196 - protein, 5 aa, Artificial Sequence
  Description of Artificial Sequence: Synthetic peptide
GILND

SEQ ID NO: 2197 - protein, 5 aa, Artificial Sequence
  Description of Artificial Sequence: Synthetic peptide
ETLKV

SEQ ID NO: 2198 - protein, 5 aa, Artificial Sequence
  Description of Artificial Sequence: Synthetic peptide
THLKE

SEQ ID NO: 2199 - protein, 5 aa, Artificial Sequence
  Description of Artificial Sequence: Synthetic peptide
NALRV

SEQ ID NO: 2200 - protein, 5 aa, Artificial Sequence
  Description of Artificial Sequence: Synthetic peptide
NRLGE

SEQ ID NO: 2201 - protein, 5 aa, Artificial Sequence
  Description of Artificial Sequence: Synthetic peptide
SRLRD

SEQ ID NO: 2202 - protein, 5 aa, Artificial Sequence
  Description of Artificial Sequence: Synthetic peptide
APLLR

SEQ ID NO: 2203 - protein, 5 aa, Artificial Sequence
  Description of Artificial Sequence: Synthetic peptide
DKLKV

SEQ ID NO: 2204 - protein, 5 aa, Artificial Sequence
  Description of Artificial Sequence: Synthetic peptide
HRLEE

SEQ ID NO: 2205 - protein, 5 aa, Artificial Sequence
  Description of Artificial Sequence: Synthetic peptide
HTLKG

SEQ ID NO: 2206 - protein, 5 aa, Artificial Sequence
  Description of Artificial Sequence: Synthetic peptide
MVLVV

SEQ ID NO: 2207 - protein, 5 aa, Artificial Sequence
  Description of Artificial Sequence: Synthetic peptide
NRLKD

SEQ ID NO: 2208 - protein, 5 aa, Artificial Sequence
  Description of Artificial Sequence: Synthetic peptide
NTLKA

SEQ ID NO: 2209 - protein, 5 aa, Artificial Sequence
  Description of Artificial Sequence: Synthetic peptide
SRLKQ

SEQ ID NO: 2210 - protein, 5 aa, Artificial Sequence
  Description of Artificial Sequence: Synthetic peptide
AQMKE

SEQ ID NO: 2211 - protein, 5 aa, Artificial Sequence
  Description of Artificial Sequence: Synthetic peptide
ARRRE

SEQ ID NO: 2212 - protein, 4 aa, Artificial Sequence
  Description of Artificial Sequence: Synthetic peptide
CRLM

SEQ ID NO: 2213 - protein, 5 aa, Artificial Sequence
  Description of Artificial Sequence: Synthetic peptide
CRLMV

SEQ ID NO: 2214 - protein, 5 aa, Artificial Sequence
  Description of Artificial Sequence: Synthetic peptide
DRLKA

SEQ ID NO: 2215 - protein, 5 aa, Artificial Sequence
  Description of Artificial Sequence: Synthetic peptide
DRLKT

SEQ ID NO: 2216 - protein, 5 aa, Artificial Sequence
  Description of Artificial Sequence: Synthetic peptide
DTPKA

SEQ ID NO: 2217 - protein, 5 aa, Artificial Sequence
  Description of Artificial Sequence: Synthetic peptide
GRLKA

SEQ ID NO: 2218 - protein, 5 aa, Artificial Sequence
  Description of Artificial Sequence: Synthetic peptide
GRLKV

SEQ ID NO: 2219 - protein, 5 aa, Artificial Sequence
  Description of Artificial Sequence: Synthetic peptide
GVLKE

SEQ ID NO: 2220 - protein, 5 aa, Artificial Sequence
  Description of Artificial Sequence: Synthetic peptide
GVLTG

SEQ ID NO: 2221 - protein, 5 aa, Artificial Sequence
  Description of Artificial Sequence: Synthetic peptide
HALDV

SEQ ID NO: 2222 - protein, 5 aa, Artificial Sequence
  Description of Artificial Sequence: Synthetic peptide
HELKV

SEQ ID NO: 2223 - protein, 5 aa, Artificial Sequence
  Description of Artificial Sequence: Synthetic peptide
HGLEA

SEQ ID NO: 2224 - protein, 5 aa, Artificial Sequence
  Description of Artificial Sequence: Synthetic peptide
HGLRG

SEQ ID NO: 2225 - protein, 5 aa, Artificial Sequence
  Description of Artificial Sequence: Synthetic peptide
HGMKA

SEQ ID NO: 2226 - protein, 5 aa, Artificial Sequence
  Description of Artificial Sequence: Synthetic peptide
HGPKV

SEQ ID NO: 2227 - protein, 5 aa, Artificial Sequence
  Description of Artificial Sequence: Synthetic peptide
HILKE

SEQ ID NO: 2228 - protein, 5 aa, Artificial Sequence
  Description of Artificial Sequence: Synthetic peptide
HILKV

SEQ ID NO: 2229 - protein, 5 aa, Artificial Sequence
  Description of Artificial Sequence: Synthetic peptide
HILNA

SEQ ID NO: 2230 - protein, 5 aa, Artificial Sequence
  Description of Artificial Sequence: Synthetic peptide
HKLKG

SEQ ID NO: 2231 - protein, 5 aa, Artificial Sequence
  Description of Artificial Sequence: Synthetic peptide
HKLKQ

SEQ ID NO: 2232 - protein, 5 aa, Artificial Sequence
  Description of Artificial Sequence: Synthetic peptide
HPLKE

SEQ ID NO: 2233 - protein, 5 aa, Artificial Sequence
  Description of Artificial Sequence: Synthetic peptide
HRLGV

SEQ ID NO: 2234 - protein, 5 aa, Artificial Sequence
  Description of Artificial Sequence: Synthetic peptide
HRLLE

SEQ ID NO: 2235 - protein, 5 aa, Artificial Sequence
  Description of Artificial Sequence: Synthetic peptide
HRLQG

SEQ ID NO: 2236 - protein, 5 aa, Artificial Sequence
  Description of Artificial Sequence: Synthetic peptide
HRLRS

SEQ ID NO: 2237 - protein, 5 aa, Artificial Sequence
  Description of Artificial Sequence: Synthetic peptide
HRLTV

SEQ ID NO: 2238 - protein, 4 aa, Artificial Sequence
  Description of Artificial Sequence: Synthetic peptide
HSGG

SEQ ID NO: 2239 - protein, 5 aa, Artificial Sequence
  Description of Artificial Sequence: Synthetic peptide
HSLKQ

SEQ ID NO: 2240 - protein, 5 aa, Artificial Sequence
  Description of Artificial Sequence: Synthetic peptide
HSLRE

SEQ ID NO: 2241 - protein, 5 aa, Artificial Sequence
  Description of Artificial Sequence: Synthetic peptide
HSVKA

SEQ ID NO: 2242 - protein, 4 aa, Artificial Sequence
  Description of Artificial Sequence: Synthetic peptide
HTGR

SEQ ID NO: 2243 - protein, 5 aa, Artificial Sequence
  Description of Artificial Sequence: Synthetic peptide
HTLEV

SEQ ID NO: 2244 - protein, 5 aa, Artificial Sequence
  Description of Artificial Sequence: Synthetic peptide
HTLMV

SEQ ID NO: 2245 - protein, 5 aa, Artificial Sequence
  Description of Artificial Sequence: Synthetic peptide
HTLQE

SEQ ID NO: 2246 - protein, 5 aa, Artificial Sequence
  Description of Artificial Sequence: Synthetic peptide
HTLRQ

SEQ ID NO: 2247 - protein, 5 aa, Artificial Sequence
  Description of Artificial Sequence: Synthetic peptide
IRLKE

SEQ ID NO: 2248 - protein, 5 aa, Artificial Sequence
  Description of Artificial Sequence: Synthetic peptide
IRQEE

SEQ ID NO: 2249 - protein, 5 aa, Artificial Sequence
  Description of Artificial Sequence: Synthetic peptide
KRLKV

SEQ ID NO: 2250 - protein, 5 aa, Artificial Sequence
  Description of Artificial Sequence: Synthetic peptide
LRLKK

SEQ ID NO: 2251 - protein, 5 aa, Artificial Sequence
  Description of Artificial Sequence: Synthetic peptide
NKLKE

SEQ ID NO: 2252 - protein, 5 aa, Artificial Sequence
  Description of Artificial Sequence: Synthetic peptide
NKLKG

SEQ ID NO: 2253 - protein, 5 aa, Artificial Sequence
  Description of Artificial Sequence: Synthetic peptide
NRLAE

SEQ ID NO: 2254 - protein, 5 aa, Artificial Sequence
  Description of Artificial Sequence: Synthetic peptide
NRLEE

SEQ ID NO: 2255 - protein, 5 aa, Artificial Sequence
  Description of Artificial Sequence: Synthetic peptide
NRLKS

SEQ ID NO: 2256 - protein, 5 aa, Artificial Sequence
  Description of Artificial Sequence: Synthetic peptide
NRLRG

SEQ ID NO: 2257 - protein, 5 aa, Artificial Sequence
  Description of Artificial Sequence: Synthetic peptide
NRLTE

SEQ ID NO: 2258 - protein, 4 aa, Artificial Sequence
  Description of Artificial Sequence: Synthetic peptide
PAEG

SEQ ID NO: 2259 - protein, 5 aa, Artificial Sequence
  Description of Artificial Sequence: Synthetic peptide
PPPPE

SEQ ID NO: 2260 - protein, 5 aa, Artificial Sequence
  Description of Artificial Sequence: Synthetic peptide
QGRRE

SEQ ID NO: 2261 - protein, 5 aa, Artificial Sequence
  Description of Artificial Sequence: Synthetic peptide
QRLEE

SEQ ID NO: 2262 - protein, 5 aa, Artificial Sequence
  Description of Artificial Sequence: Synthetic peptide
QSLGR

SEQ ID NO: 2263 - protein, 4 aa, Artificial Sequence
  Description of Artificial Sequence: Synthetic peptide
SKLK

SEQ ID NO: 2264 - protein, 5 aa, Artificial Sequence
  Description of Artificial Sequence: Synthetic peptide
SMLRE

SEQ ID NO: 2265 - protein, 5 aa, Artificial Sequence
  Description of Artificial Sequence: Synthetic peptide
SRLAE

SEQ ID NO: 2266 - protein, 5 aa, Artificial Sequence
  Description of Artificial Sequence: Synthetic peptide
SRLCE

SEQ ID NO: 2267 - protein, 5 aa, Artificial Sequence
  Description of Artificial Sequence: Synthetic peptide
SRLLE

SEQ ID NO: 2268 - protein, 5 aa, Artificial Sequence
  Description of Artificial Sequence: Synthetic peptide
SRRKE

SEQ ID NO: 2269 - protein, 5 aa, Artificial Sequence
  Description of Artificial Sequence: Synthetic peptide
TGLRE

SEQ ID NO: 2270 - protein, 5 aa, Artificial Sequence
  Description of Artificial Sequence: Synthetic peptide
THLKV

SEQ ID NO: 2271 - protein, 5 aa, Artificial Sequence
  Description of Artificial Sequence: Synthetic peptide
TILYE

SEQ ID NO: 2272 - protein, 5 aa, Artificial Sequence
  Description of Artificial Sequence: Synthetic peptide
TLLKE

SEQ ID NO: 2273 - protein, 5 aa, Artificial Sequence
  Description of Artificial Sequence: Synthetic peptide
TRLTV

SEQ ID NO: 2274 - protein, 5 aa, Artificial Sequence
  Description of Artificial Sequence: Synthetic peptide
TRMGE

SEQ ID NO: 2275 - protein, 5 aa, Artificial Sequence
  Description of Artificial Sequence: Synthetic peptide
TRMKQ

SEQ ID NO: 2276 - protein, 5 aa, Artificial Sequence
  Description of Artificial Sequence: Synthetic peptide
YTLKE

SEQ ID NO: 2277 - protein, 4 aa, Artificial Sequence
  Description of Artificial Sequence: Synthetic peptide
HTLA

SEQ ID NO: 2278 - protein, 5 aa, Artificial Sequence
  Description of Artificial Sequence: Synthetic peptide
SKLKQ

SEQ ID NO: 2279 - protein, 5 aa, Artificial Sequence
  Description of Artificial Sequence: Synthetic peptide
HALRV

SEQ ID NO: 2280 - protein, 5 aa, Artificial Sequence
  Description of Artificial Sequence: Synthetic peptide
GILKV

SEQ ID NO: 2281 - protein, 5 aa, Artificial Sequence
  Description of Artificial Sequence: Synthetic peptide
SVLKQ

SEQ ID NO: 2282 - protein, 5 aa, Artificial Sequence
  Description of Artificial Sequence: Synthetic peptide
GQLHV

SEQ ID NO: 2283 - protein, 5 aa, Artificial Sequence
  Description of Artificial Sequence: Synthetic peptide
TTLRQ

SEQ ID NO: 2284 - protein, 5 aa, Artificial Sequence
  Description of Artificial Sequence: Synthetic peptide
DTLKN

SEQ ID NO: 2285 - protein, 5 aa, Artificial Sequence
  Description of Artificial Sequence: Synthetic peptide
GVLKV

SEQ ID NO: 2286 - protein, 5 aa, Artificial Sequence
  Description of Artificial Sequence: Synthetic peptide
GTLKA

SEQ ID NO: 2287 - protein, 5 aa, Artificial Sequence
  Description of Artificial Sequence: Synthetic peptide
SVLKV

SEQ ID NO: 2288 - protein, 5 aa, Artificial Sequence
  Description of Artificial Sequence: Synthetic peptide
TVLKV

SEQ ID NO: 2289 - protein, 5 aa, Artificial Sequence
  Description of Artificial Sequence: Synthetic peptide
HHLRQ

SEQ ID NO: 2290 - protein, 5 aa, Artificial Sequence
  Description of Artificial Sequence: Synthetic peptide
NTLRQ

SEQ ID NO: 2291 - protein, 5 aa, Artificial Sequence
  Description of Artificial Sequence: Synthetic peptide
QTLKQ

SEQ ID NO: 2292 - protein, 5 aa, Artificial Sequence
  Description of Artificial Sequence: Synthetic peptide
RTLKQ

SEQ ID NO: 2293 - protein, 5 aa, Artificial Sequence
  Description of Artificial Sequence: Synthetic peptide
STLKG

SEQ ID NO: 2294 - protein, 5 aa, Artificial Sequence
  Description of Artificial Sequence: Synthetic peptide
TVLKQ

SEQ ID NO: 2295 - protein, 5 aa, Artificial Sequence
  Description of Artificial Sequence: Synthetic peptide
GGLVV

SEQ ID NO: 2296 - protein, 5 aa, Artificial Sequence
  Description of Artificial Sequence: Synthetic peptide
HGLQV

SEQ ID NO: 2297 - protein, 5 aa, Artificial Sequence
  Description of Artificial Sequence: Synthetic peptide
DTLKG

SEQ ID NO: 2298 - protein, 5 aa, Artificial Sequence
  Description of Artificial Sequence: Synthetic peptide
GGLTV

SEQ ID NO: 2299 - protein, 5 aa, Artificial Sequence
  Description of Artificial Sequence: Synthetic peptide
GVLKA

SEQ ID NO: 2300 - protein, 5 aa, Artificial Sequence
  Description of Artificial Sequence: Synthetic peptide
GTLRQ

SEQ ID NO: 2301 - protein, 5 aa, Artificial Sequence
  Description of Artificial Sequence: Synthetic peptide
HALKQ

SEQ ID NO: 2302 - protein, 5 aa, Artificial Sequence
  Description of Artificial Sequence: Synthetic peptide
STLKT

SEQ ID NO: 2303 - protein, 5 aa, Artificial Sequence
  Description of Artificial Sequence: Synthetic peptide
ATLKA

SEQ ID NO: 2304 - protein, 5 aa, Artificial Sequence
  Description of Artificial Sequence: Synthetic peptide
ATLKQ

SEQ ID NO: 2305 - protein, 5 aa, Artificial Sequence
  Description of Artificial Sequence: Synthetic peptide
DGLKQ

SEQ ID NO: 2306 - protein, 5 aa, Artificial Sequence
  Description of Artificial Sequence: Synthetic peptide
GTLNA

SEQ ID NO: 2307 - protein, 5 aa, Artificial Sequence
  Description of Artificial Sequence: Synthetic peptide
GVLKN

SEQ ID NO: 2308 - protein, 5 aa, Artificial Sequence
  Description of Artificial Sequence: Synthetic peptide
TTLKG

SEQ ID NO: 2309 - protein, 5 aa, Artificial Sequence
  Description of Artificial Sequence: Synthetic peptide
ETLRV

SEQ ID NO: 2310 - protein, 5 aa, Artificial Sequence
  Description of Artificial Sequence: Synthetic peptide
HGLKG

SEQ ID NO: 2311 - protein, 5 aa, Artificial Sequence
  Description of Artificial Sequence: Synthetic peptide
HGLNV

SEQ ID NO: 2312 - protein, 5 aa, Artificial Sequence
  Description of Artificial Sequence: Synthetic peptide
VGLGE

SEQ ID NO: 2313 - protein, 5 aa, Artificial Sequence
  Description of Artificial Sequence: Synthetic peptide
AGLAT

SEQ ID NO: 2314 - protein, 4 aa, Artificial Sequence
  Description of Artificial Sequence: Synthetic peptide
DLPG

SEQ ID NO: 2315 - protein, 5 aa, Artificial Sequence
  Description of Artificial Sequence: Synthetic peptide
DKLRV

SEQ ID NO: 2316 - protein, 5 aa, Artificial Sequence
  Description of Artificial Sequence: Synthetic peptide
HTQKV

SEQ ID NO: 2317 - protein, 5 aa, Artificial Sequence
  Description of Artificial Sequence: Synthetic peptide
DGLRA

SEQ ID NO: 2318 - protein, 5 aa, Artificial Sequence
  Description of Artificial Sequence: Synthetic peptide
DVLKV

SEQ ID NO: 2319 - protein, 5 aa, Artificial Sequence
  Description of Artificial Sequence: Synthetic peptide
GALRV

SEQ ID NO: 2320 - protein, 5 aa, Artificial Sequence
  Description of Artificial Sequence: Synthetic peptide
GGLVQ

SEQ ID NO: 2321 - protein, 5 aa, Artificial Sequence
  Description of Artificial Sequence: Synthetic peptide
GNLKV

SEQ ID NO: 2322 - protein, 5 aa, Artificial Sequence
  Description of Artificial Sequence: Synthetic peptide
GPLKV

SEQ ID NO: 2323 - protein, 5 aa, Artificial Sequence
  Description of Artificial Sequence: Synthetic peptide
GTLKG

SEQ ID NO: 2324 - protein, 5 aa, Artificial Sequence
  Description of Artificial Sequence: Synthetic peptide
GVLKQ

SEQ ID NO: 2325 - protein, 5 aa, Artificial Sequence
  Description of Artificial Sequence: Synthetic peptide
GVLRV

SEQ ID NO: 2326 - protein, 5 aa, Artificial Sequence
  Description of Artificial Sequence: Synthetic peptide
HDLKV

SEQ ID NO: 2327 - protein, 5 aa, Artificial Sequence
  Description of Artificial Sequence: Synthetic peptide
HGLEV

SEQ ID NO: 2328 - protein, 5 aa, Artificial Sequence
  Description of Artificial Sequence: Synthetic peptide
HHMVQ

SEQ ID NO: 2329 - protein, 5 aa, Artificial Sequence
  Description of Artificial Sequence: Synthetic peptide
HKLKA

SEQ ID NO: 2330 - protein, 5 aa, Artificial Sequence
  Description of Artificial Sequence: Synthetic peptide
HRLKQ

SEQ ID NO: 2331 - protein, 5 aa, Artificial Sequence
  Description of Artificial Sequence: Synthetic peptide
KTLKV

SEQ ID NO: 2332 - protein, 5 aa, Artificial Sequence
  Description of Artificial Sequence: Synthetic peptide
PTLKV

SEQ ID NO: 2333 - protein, 5 aa, Artificial Sequence
  Description of Artificial Sequence: Synthetic peptide
RLLPY

SEQ ID NO: 2334 - protein, 5 aa, Artificial Sequence
  Description of Artificial Sequence: Synthetic peptide
RLRPN

SEQ ID NO: 2335 - protein, 5 aa, Artificial Sequence
  Description of Artificial Sequence: Synthetic peptide
RTLAQ

SEQ ID NO: 2336 - protein, 5 aa, Artificial Sequence
  Description of Artificial Sequence: Synthetic peptide
RTLKV

SEQ ID NO: 2337 - protein, 5 aa, Artificial Sequence
  Description of Artificial Sequence: Synthetic peptide
SALTV

SEQ ID NO: 2338 - protein, 5 aa, Artificial Sequence
  Description of Artificial Sequence: Synthetic peptide
STLKL

SEQ ID NO: 2339 - protein, 5 aa, Artificial Sequence
  Description of Artificial Sequence: Synthetic peptide
TKLKQ

SEQ ID NO: 2340 - protein, 5 aa, Artificial Sequence
  Description of Artificial Sequence: Synthetic peptide
TTPKV

SEQ ID NO: 2341 - protein, 5 aa, Artificial Sequence
  Description of Artificial Sequence: Synthetic peptide
AGLAS

SEQ ID NO: 2342 - protein, 5 aa, Artificial Sequence
  Description of Artificial Sequence: Synthetic peptide
AGLKM

SEQ ID NO: 2343 - protein, 5 aa, Artificial Sequence
  Description of Artificial Sequence: Synthetic peptide
APLKV

SEQ ID NO: 2344 - protein, 5 aa, Artificial Sequence
  Description of Artificial Sequence: Synthetic peptide
ATLKG

SEQ ID NO: 2345 - protein, 5 aa, Artificial Sequence
  Description of Artificial Sequence: Synthetic peptide
DELRQ

SEQ ID NO: 2346 - protein, 5 aa, Artificial Sequence
  Description of Artificial Sequence: Synthetic peptide
DGLKA

SEQ ID NO: 2347 - protein, 5 aa, Artificial Sequence
  Description of Artificial Sequence: Synthetic peptide
DGLKL

SEQ ID NO: 2348 - protein, 5 aa, Artificial Sequence
  Description of Artificial Sequence: Synthetic peptide
DKLKG

SEQ ID NO: 2349 - protein, 5 aa, Artificial Sequence
  Description of Artificial Sequence: Synthetic peptide
DSLKV

SEQ ID NO: 2350 - protein, 5 aa, Artificial Sequence
  Description of Artificial Sequence: Synthetic peptide
DTLNQ

SEQ ID NO: 2351 - protein, 5 aa, Artificial Sequence
  Description of Artificial Sequence: Synthetic peptide
DTLWQ

SEQ ID NO: 2352 - protein, 5 aa, Artificial Sequence
  Description of Artificial Sequence: Synthetic peptide
DTMKV

SEQ ID NO: 2353 - protein, 5 aa, Artificial Sequence
  Description of Artificial Sequence: Synthetic peptide
EGLKQ

SEQ ID NO: 2354 - protein, 5 aa, Artificial Sequence
  Description of Artificial Sequence: Synthetic peptide
ETLKE

SEQ ID NO: 2355 - protein, 5 aa, Artificial Sequence
  Description of Artificial Sequence: Synthetic peptide
ETRRV

SEQ ID NO: 2356 - protein, 5 aa, Artificial Sequence
  Description of Artificial Sequence: Synthetic peptide
GGLAV

SEQ ID NO: 2357 - protein, 5 aa, Artificial Sequence
  Description of Artificial Sequence: Synthetic peptide
GGLRG

SEQ ID NO: 2358 - protein, 5 aa, Artificial Sequence
  Description of Artificial Sequence: Synthetic peptide
GGLRV

SEQ ID NO: 2359 - protein, 5 aa, Artificial Sequence
  Description of Artificial Sequence: Synthetic peptide
GHLKA

SEQ ID NO: 2360 - protein, 5 aa, Artificial Sequence
  Description of Artificial Sequence: Synthetic peptide
GPLRA

SEQ ID NO: 2361 - protein, 5 aa, Artificial Sequence
  Description of Artificial Sequence: Synthetic peptide
GQQHV

SEQ ID NO: 2362 - protein, 5 aa, Artificial Sequence
  Description of Artificial Sequence: Synthetic peptide
GTLQA

SEQ ID NO: 2363 - protein, 5 aa, Artificial Sequence
  Description of Artificial Sequence: Synthetic peptide
GTPKV

SEQ ID NO: 2364 - protein, 5 aa, Artificial Sequence
  Description of Artificial Sequence: Synthetic peptide
HALES

SEQ ID NO: 2365 - protein, 5 aa, Artificial Sequence
  Description of Artificial Sequence: Synthetic peptide
HALKF

SEQ ID NO: 2366 - protein, 5 aa, Artificial Sequence
  Description of Artificial Sequence: Synthetic peptide
HALMV

SEQ ID NO: 2367 - protein, 5 aa, Artificial Sequence
  Description of Artificial Sequence: Synthetic peptide
HAMKV

SEQ ID NO: 2368 - protein, 5 aa, Artificial Sequence
  Description of Artificial Sequence: Synthetic peptide
HARKV

SEQ ID NO: 2369 - protein, 5 aa, Artificial Sequence
  Description of Artificial Sequence: Synthetic peptide
HGLKD

SEQ ID NO: 2370 - protein, 5 aa, Artificial Sequence
  Description of Artificial Sequence: Synthetic peptide
HGLKL

SEQ ID NO: 2371 - protein, 5 aa, Artificial Sequence
  Description of Artificial Sequence: Synthetic peptide
HGLKM

SEQ ID NO: 2372 - protein, 5 aa, Artificial Sequence
  Description of Artificial Sequence: Synthetic peptide
HGLKW

SEQ ID NO: 2373 - protein, 5 aa, Artificial Sequence
  Description of Artificial Sequence: Synthetic peptide
HGRKI

SEQ ID NO: 2374 - protein, 5 aa, Artificial Sequence
  Description of Artificial Sequence: Synthetic peptide
HHLAQ

SEQ ID NO: 2375 - protein, 5 aa, Artificial Sequence
  Description of Artificial Sequence: Synthetic peptide
HHLGQ

SEQ ID NO: 2376 - protein, 5 aa, Artificial Sequence
  Description of Artificial Sequence: Synthetic peptide
HHLMQ

SEQ ID NO: 2377 - protein, 5 aa, Artificial Sequence
  Description of Artificial Sequence: Synthetic peptide
HHMKV

SEQ ID NO: 2378 - protein, 5 aa, Artificial Sequence
  Description of Artificial Sequence: Synthetic peptide
HKLKM

SEQ ID NO: 2379 - protein, 5 aa, Artificial Sequence
  Description of Artificial Sequence: Synthetic peptide
HKLNV

SEQ ID NO: 2380 - protein, 5 aa, Artificial Sequence
  Description of Artificial Sequence: Synthetic peptide
HKLQE

SEQ ID NO: 2381 - protein, 5 aa, Artificial Sequence
  Description of Artificial Sequence: Synthetic peptide
HMLNV

SEQ ID NO: 2382 - protein, 5 aa, Artificial Sequence
  Description of Artificial Sequence: Synthetic peptide
HPLDV

SEQ ID NO: 2383 - protein, 5 aa, Artificial Sequence
  Description of Artificial Sequence: Synthetic peptide
HPLQV

SEQ ID NO: 2384 - protein, 5 aa, Artificial Sequence
  Description of Artificial Sequence: Synthetic peptide
HQLKA

SEQ ID NO: 2385 - protein, 5 aa, Artificial Sequence
  Description of Artificial Sequence: Synthetic peptide
HQLKG

SEQ ID NO: 2386 - protein, 5 aa, Artificial Sequence
  Description of Artificial Sequence: Synthetic peptide
HQLKT

SEQ ID NO: 2387 - protein, 5 aa, Artificial Sequence
  Description of Artificial Sequence: Synthetic peptide
HSLKA

SEQ ID NO: 2388 - protein, 5 aa, Artificial Sequence
  Description of Artificial Sequence: Synthetic peptide
HSLKG

SEQ ID NO: 2389 - protein, 5 aa, Artificial Sequence
  Description of Artificial Sequence: Synthetic peptide
HSLKL

SEQ ID NO: 2390 - protein, 5 aa, Artificial Sequence
  Description of Artificial Sequence: Synthetic peptide
HTLAV

SEQ ID NO: 2391 - protein, 5 aa, Artificial Sequence
  Description of Artificial Sequence: Synthetic peptide
HTLKN

SEQ ID NO: 2392 - protein, 5 aa, Artificial Sequence
  Description of Artificial Sequence: Synthetic peptide
HTLNA

SEQ ID NO: 2393 - protein, 5 aa, Artificial Sequence
  Description of Artificial Sequence: Synthetic peptide
HTLQV

SEQ ID NO: 2394 - protein, 5 aa, Artificial Sequence
  Description of Artificial Sequence: Synthetic peptide
HTLTV

SEQ ID NO: 2395 - protein, 5 aa, Artificial Sequence
  Description of Artificial Sequence: Synthetic peptide
HTPKV

SEQ ID NO: 2396 - protein, 5 aa, Artificial Sequence
  Description of Artificial Sequence: Synthetic peptide
HTRKQ

SEQ ID NO: 2397 - protein, 5 aa, Artificial Sequence
  Description of Artificial Sequence: Synthetic peptide
HVLKF

SEQ ID NO: 2398 - protein, 5 aa, Artificial Sequence
  Description of Artificial Sequence: Synthetic peptide
HVMKV

SEQ ID NO: 2399 - protein, 5 aa, Artificial Sequence
  Description of Artificial Sequence: Synthetic peptide
HWLKV

SEQ ID NO: 2400 - protein, 5 aa, Artificial Sequence
  Description of Artificial Sequence: Synthetic peptide
KADTV

SEQ ID NO: 2401 - protein, 5 aa, Artificial Sequence
  Description of Artificial Sequence: Synthetic peptide
KGLKG

SEQ ID NO: 2402 - protein, 5 aa, Artificial Sequence
  Description of Artificial Sequence: Synthetic peptide
KRLKQ

SEQ ID NO: 2403 - protein, 5 aa, Artificial Sequence
  Description of Artificial Sequence: Synthetic peptide
KTLAQ

SEQ ID NO: 2404 - protein, 5 aa, Artificial Sequence
  Description of Artificial Sequence: Synthetic peptide
KTLRV

SEQ ID NO: 2405 - protein, 5 aa, Artificial Sequence
  Description of Artificial Sequence: Synthetic peptide
KTLTQ

SEQ ID NO: 2406 - protein, 5 aa, Artificial Sequence
  Description of Artificial Sequence: Synthetic peptide
LHLKV

SEQ ID NO: 2407 - protein, 5 aa, Artificial Sequence
  Description of Artificial Sequence: Synthetic peptide
LTLKQ

SEQ ID NO: 2408 - protein, 5 aa, Artificial Sequence
  Description of Artificial Sequence: Synthetic peptide
LTLKV

SEQ ID NO: 2409 - protein, 5 aa, Artificial Sequence
  Description of Artificial Sequence: Synthetic peptide
MGLKV

SEQ ID NO: 2410 - protein, 4 aa, Artificial Sequence
  Description of Artificial Sequence: Synthetic peptide
MPPK

SEQ ID NO: 2411 - protein, 5 aa, Artificial Sequence
  Description of Artificial Sequence: Synthetic peptide
MRLKQ

SEQ ID NO: 2412 - protein, 5 aa, Artificial Sequence
  Description of Artificial Sequence: Synthetic peptide
NAVTE

SEQ ID NO: 2413 - protein, 5 aa, Artificial Sequence
  Description of Artificial Sequence: Synthetic peptide
NGLKG

SEQ ID NO: 2414 - protein, 5 aa, Artificial Sequence
  Description of Artificial Sequence: Synthetic peptide
NGLKL

SEQ ID NO: 2415 - protein, 5 aa, Artificial Sequence
  Description of Artificial Sequence: Synthetic peptide
NRLKG

SEQ ID NO: 2416 - protein, 5 aa, Artificial Sequence
  Description of Artificial Sequence: Synthetic peptide
NTLRV

SEQ ID NO: 2417 - protein, 5 aa, Artificial Sequence
  Description of Artificial Sequence: Synthetic peptide
PGLKV

SEQ ID NO: 2418 - protein, 5 aa, Artificial Sequence
  Description of Artificial Sequence: Synthetic peptide
QGLKV

SEQ ID NO: 2419 - protein, 5 aa, Artificial Sequence
  Description of Artificial Sequence: Synthetic peptide
QRQRV

SEQ ID NO: 2420 - protein, 5 aa, Artificial Sequence
  Description of Artificial Sequence: Synthetic peptide
QTLKA

SEQ ID NO: 2421 - protein, 5 aa, Artificial Sequence
  Description of Artificial Sequence: Synthetic peptide
QTLKG

SEQ ID NO: 2422 - protein, 5 aa, Artificial Sequence
  Description of Artificial Sequence: Synthetic peptide
QTLKK

SEQ ID NO: 2423 - protein, 5 aa, Artificial Sequence
  Description of Artificial Sequence: Synthetic peptide
QTLKM

SEQ ID NO: 2424 - protein, 5 aa, Artificial Sequence
  Description of Artificial Sequence: Synthetic peptide
QTLMV

SEQ ID NO: 2425 - protein, 5 aa, Artificial Sequence
  Description of Artificial Sequence: Synthetic peptide
RHLVQ

SEQ ID NO: 2426 - protein, 5 aa, Artificial Sequence
  Description of Artificial Sequence: Synthetic peptide
RLLPT

SEQ ID NO: 2427 - protein, 5 aa, Artificial Sequence
  Description of Artificial Sequence: Synthetic peptide
RLLSN

SEQ ID NO: 2428 - protein, 5 aa, Artificial Sequence
  Description of Artificial Sequence: Synthetic peptide
RLMPD

SEQ ID NO: 2429 - protein, 5 aa, Artificial Sequence
  Description of Artificial Sequence: Synthetic peptide
RMLPN

SEQ ID NO: 2430 - protein, 5 aa, Artificial Sequence
  Description of Artificial Sequence: Synthetic peptide
RSLKV

SEQ ID NO: 2431 - protein, 5 aa, Artificial Sequence
  Description of Artificial Sequence: Synthetic peptide
RTLKG

SEQ ID NO: 2432 - protein, 5 aa, Artificial Sequence
  Description of Artificial Sequence: Synthetic peptide
SALKQ

SEQ ID NO: 2433 - protein, 5 aa, Artificial Sequence
  Description of Artificial Sequence: Synthetic peptide
SALRQ

SEQ ID NO: 2434 - protein, 5 aa, Artificial Sequence
  Description of Artificial Sequence: Synthetic peptide
SELKV

SEQ ID NO: 2435 - protein, 5 aa, Artificial Sequence
  Description of Artificial Sequence: Synthetic peptide
SFLKV

SEQ ID NO: 2436 - protein, 5 aa, Artificial Sequence
  Description of Artificial Sequence: Synthetic peptide
SGLKQ

SEQ ID NO: 2437 - protein, 5 aa, Artificial Sequence
  Description of Artificial Sequence: Synthetic peptide
SHLKQ

SEQ ID NO: 2438 - protein, 5 aa, Artificial Sequence
  Description of Artificial Sequence: Synthetic peptide
SKLKA

SEQ ID NO: 2439 - protein, 5 aa, Artificial Sequence
  Description of Artificial Sequence: Synthetic peptide
STLKK

SEQ ID NO: 2440 - protein, 5 aa, Artificial Sequence
  Description of Artificial Sequence: Synthetic peptide
STLKM

SEQ ID NO: 2441 - protein, 5 aa, Artificial Sequence
  Description of Artificial Sequence: Synthetic peptide
STMKA

SEQ ID NO: 2442 - protein, 5 aa, Artificial Sequence
  Description of Artificial Sequence: Synthetic peptide
STMKV

SEQ ID NO: 2443 - protein, 5 aa, Artificial Sequence
  Description of Artificial Sequence: Synthetic peptide
TALKV

SEQ ID NO: 2444 - protein, 5 aa, Artificial Sequence
  Description of Artificial Sequence: Synthetic peptide
TGLKA

SEQ ID NO: 2445 - protein, 5 aa, Artificial Sequence
  Description of Artificial Sequence: Synthetic peptide
TGLKD

SEQ ID NO: 2446 - protein, 5 aa, Artificial Sequence
  Description of Artificial Sequence: Synthetic peptide
TGLMV

SEQ ID NO: 2447 - protein, 5 aa, Artificial Sequence
  Description of Artificial Sequence: Synthetic peptide
THLKG

SEQ ID NO: 2448 - protein, 5 aa, Artificial Sequence
  Description of Artificial Sequence: Synthetic peptide
THLKL

SEQ ID NO: 2449 - protein, 5 aa, Artificial Sequence
  Description of Artificial Sequence: Synthetic peptide
THLKQ

SEQ ID NO: 2450 - protein, 5 aa, Artificial Sequence
  Description of Artificial Sequence: Synthetic peptide
THLMV

SEQ ID NO: 2451 - protein, 5 aa, Artificial Sequence
  Description of Artificial Sequence: Synthetic peptide
TPLQV

SEQ ID NO: 2452 - protein, 5 aa, Artificial Sequence
  Description of Artificial Sequence: Synthetic peptide
TRLPQ

SEQ ID NO: 2453 - protein, 5 aa, Artificial Sequence
  Description of Artificial Sequence: Synthetic peptide
TTLEV

SEQ ID NO: 2454 - protein, 5 aa, Artificial Sequence
  Description of Artificial Sequence: Synthetic peptide
TTLHV

SEQ ID NO: 2455 - protein, 5 aa, Artificial Sequence
  Description of Artificial Sequence: Synthetic peptide
TTLRG

SEQ ID NO: 2456 - protein, 5 aa, Artificial Sequence
  Description of Artificial Sequence: Synthetic peptide
TTLYV

SEQ ID NO: 2457 - protein, 5 aa, Artificial Sequence
  Description of Artificial Sequence: Synthetic peptide
TTMKV

SEQ ID NO: 2458 - protein, 5 aa, Artificial Sequence
  Description of Artificial Sequence: Synthetic peptide
TVLRQ

SEQ ID NO: 2459 - protein, 5 aa, Artificial Sequence
  Description of Artificial Sequence: Synthetic peptide
VGLGG

SEQ ID NO: 2460 - protein, 5 aa, Artificial Sequence
  Description of Artificial Sequence: Synthetic peptide
VTLKV

SEQ ID NO: 2461 - protein, 5 aa, Artificial Sequence
  Description of Artificial Sequence: Synthetic peptide
GGLRR

SEQ ID NO: 2462 - protein, 5 aa, Artificial Sequence
  Description of Artificial Sequence: Synthetic peptide
TGLRR

SEQ ID NO: 2463 - protein, 5 aa, Artificial Sequence
  Description of Artificial Sequence: Synthetic peptide
EGLRR

SEQ ID NO: 2464 - protein, 5 aa, Artificial Sequence
  Description of Artificial Sequence: Synthetic peptide
SGLRR

SEQ ID NO: 2465 - protein, 5 aa, Artificial Sequence
  Description of Artificial Sequence: Synthetic peptide
AGLAR

SEQ ID NO: 2466 - protein, 5 aa, Artificial Sequence
  Description of Artificial Sequence: Synthetic peptide
SGLAR

SEQ ID NO: 2467 - protein, 5 aa, Artificial Sequence
  Description of Artificial Sequence: Synthetic peptide
GGLAR

SEQ ID NO: 2468 - protein, 5 aa, Artificial Sequence
  Description of Artificial Sequence: Synthetic peptide
DGLAR

SEQ ID NO: 2469 - protein, 5 aa, Artificial Sequence
  Description of Artificial Sequence: Synthetic peptide
TGLAR

SEQ ID NO: 2470 - protein, 5 aa, Artificial Sequence
  Description of Artificial Sequence: Synthetic peptide
GGLQR

SEQ ID NO: 2471 - protein, 5 aa, Artificial Sequence
  Description of Artificial Sequence: Synthetic peptide
HGLAR

SEQ ID NO: 2472 - protein, 5 aa, Artificial Sequence
  Description of Artificial Sequence: Synthetic peptide
TGLVR

SEQ ID NO: 2473 - protein, 5 aa, Artificial Sequence
  Description of Artificial Sequence: Synthetic peptide
AGLTR

SEQ ID NO: 2474 - protein, 5 aa, Artificial Sequence
  Description of Artificial Sequence: Synthetic peptide
SGLSR

SEQ ID NO: 2475 - protein, 5 aa, Artificial Sequence
  Description of Artificial Sequence: Synthetic peptide
AGLRR

SEQ ID NO: 2476 - protein, 5 aa, Artificial Sequence
  Description of Artificial Sequence: Synthetic peptide
GGLSR

SEQ ID NO: 2477 - protein, 5 aa, Artificial Sequence
  Description of Artificial Sequence: Synthetic peptide
SGLTR

SEQ ID NO: 2478 - protein, 5 aa, Artificial Sequence
  Description of Artificial Sequence: Synthetic peptide
NGLVR

SEQ ID NO: 2479 - protein, 5 aa, Artificial Sequence
  Description of Artificial Sequence: Synthetic peptide
AGLQR

SEQ ID NO: 2480 - protein, 5 aa, Artificial Sequence
  Description of Artificial Sequence: Synthetic peptide
AGLHR

SEQ ID NO: 2481 - protein, 5 aa, Artificial Sequence
  Description of Artificial Sequence: Synthetic peptide
GNLER

SEQ ID NO: 2482 - protein, 5 aa, Artificial Sequence
  Description of Artificial Sequence: Synthetic peptide
HNLLR

SEQ ID NO: 2483 - protein, 5 aa, Artificial Sequence
  Description of Artificial Sequence: Synthetic peptide
HALRR

SEQ ID NO: 2484 - protein, 5 aa, Artificial Sequence
  Description of Artificial Sequence: Synthetic peptide
HGLQR

SEQ ID NO: 2485 - protein, 5 aa, Artificial Sequence
  Description of Artificial Sequence: Synthetic peptide
NGLRR

SEQ ID NO: 2486 - protein, 5 aa, Artificial Sequence
  Description of Artificial Sequence: Synthetic peptide
SGLVR

SEQ ID NO: 2487 - protein, 5 aa, Artificial Sequence
  Description of Artificial Sequence: Synthetic peptide
SNLDR

SEQ ID NO: 2488 - protein, 5 aa, Artificial Sequence
  Description of Artificial Sequence: Synthetic peptide
HGLTR

SEQ ID NO: 2489 - protein, 5 aa, Artificial Sequence
  Description of Artificial Sequence: Synthetic peptide
SSLRR

SEQ ID NO: 2490 - protein, 5 aa, Artificial Sequence
  Description of Artificial Sequence: Synthetic peptide
EGLTR

SEQ ID NO: 2491 - protein, 5 aa, Artificial Sequence
  Description of Artificial Sequence: Synthetic peptide
GGLER

SEQ ID NO: 2492 - protein, 5 aa, Artificial Sequence
  Description of Artificial Sequence: Synthetic peptide
TGLQR

SEQ ID NO: 2493 - protein, 5 aa, Artificial Sequence
  Description of Artificial Sequence: Synthetic peptide
AGLIR

SEQ ID NO: 2494 - protein, 5 aa, Artificial Sequence
  Description of Artificial Sequence: Synthetic peptide
ANLVR

SEQ ID NO: 2495 - protein, 5 aa, Artificial Sequence
  Description of Artificial Sequence: Synthetic peptide
EGLKR

SEQ ID NO: 2496 - protein, 5 aa, Artificial Sequence
  Description of Artificial Sequence: Synthetic peptide
SNLLR

SEQ ID NO: 2497 - protein, 5 aa, Artificial Sequence
  Description of Artificial Sequence: Synthetic peptide
EGLAR

SEQ ID NO: 2498 - protein, 5 aa, Artificial Sequence
  Description of Artificial Sequence: Synthetic peptide
AGLSR

SEQ ID NO: 2499 - protein, 5 aa, Artificial Sequence
  Description of Artificial Sequence: Synthetic peptide
DGLIR

SEQ ID NO: 2500 - protein, 5 aa, Artificial Sequence
  Description of Artificial Sequence: Synthetic peptide
TGLKR

SEQ ID NO: 2501 - protein, 5 aa, Artificial Sequence
  Description of Artificial Sequence: Synthetic peptide
SGLQR

SEQ ID NO: 2502 - protein, 5 aa, Artificial Sequence
  Description of Artificial Sequence: Synthetic peptide
ETLKR

SEQ ID NO: 2503 - protein, 5 aa, Artificial Sequence
  Description of Artificial Sequence: Synthetic peptide
HGLLR

SEQ ID NO: 2504 - protein, 5 aa, Artificial Sequence
  Description of Artificial Sequence: Synthetic peptide
NGLQR

SEQ ID NO: 2505 - protein, 5 aa, Artificial Sequence
  Description of Artificial Sequence: Synthetic peptide
TGLMR

SEQ ID NO: 2506 - protein, 5 aa, Artificial Sequence
  Description of Artificial Sequence: Synthetic peptide
DNLVR

SEQ ID NO: 2507 - protein, 5 aa, Artificial Sequence
  Description of Artificial Sequence: Synthetic peptide
TGLLR

SEQ ID NO: 2508 - protein, 5 aa, Artificial Sequence
  Description of Artificial Sequence: Synthetic peptide
DGLMR

SEQ ID NO: 2509 - protein, 5 aa, Artificial Sequence
  Description of Artificial Sequence: Synthetic peptide
ASLKR

SEQ ID NO: 2510 - protein, 5 aa, Artificial Sequence
  Description of Artificial Sequence: Synthetic peptide
QGLRR

SEQ ID NO: 2511 - protein, 5 aa, Artificial Sequence
  Description of Artificial Sequence: Synthetic peptide
TNLVR

SEQ ID NO: 2512 - protein, 5 aa, Artificial Sequence
  Description of Artificial Sequence: Synthetic peptide
NGLTR

SEQ ID NO: 2513 - protein, 5 aa, Artificial Sequence
  Description of Artificial Sequence: Synthetic peptide
SGLDR

SEQ ID NO: 2514 - protein, 5 aa, Artificial Sequence
  Description of Artificial Sequence: Synthetic peptide
SGLHR

SEQ ID NO: 2515 - protein, 5 aa, Artificial Sequence
  Description of Artificial Sequence: Synthetic peptide
TGLNR

SEQ ID NO: 2516 - protein, 5 aa, Artificial Sequence
  Description of Artificial Sequence: Synthetic peptide
TGLSR

SEQ ID NO: 2517 - protein, 5 aa, Artificial Sequence
  Description of Artificial Sequence: Synthetic peptide
GNLLR

SEQ ID NO: 2518 - protein, 5 aa, Artificial Sequence
  Description of Artificial Sequence: Synthetic peptide
NNLVR

SEQ ID NO: 2519 - protein, 5 aa, Artificial Sequence
  Description of Artificial Sequence: Synthetic peptide
TGLIR

SEQ ID NO: 2520 - protein, 5 aa, Artificial Sequence
  Description of Artificial Sequence: Synthetic peptide
DMLRR

SEQ ID NO: 2521 - protein, 5 aa, Artificial Sequence
  Description of Artificial Sequence: Synthetic peptide
GALKR

SEQ ID NO: 2522 - protein, 5 aa, Artificial Sequence
  Description of Artificial Sequence: Synthetic peptide
GNLDR

SEQ ID NO: 2523 - protein, 5 aa, Artificial Sequence
  Description of Artificial Sequence: Synthetic peptide
SALRR

SEQ ID NO: 2524 - protein, 5 aa, Artificial Sequence
  Description of Artificial Sequence: Synthetic peptide
SNLAR

SEQ ID NO: 2525 - protein, 5 aa, Artificial Sequence
  Description of Artificial Sequence: Synthetic peptide
SGLLR

SEQ ID NO: 2526 - protein, 5 aa, Artificial Sequence
  Description of Artificial Sequence: Synthetic peptide
TNLNR

SEQ ID NO: 2527 - protein, 5 aa, Artificial Sequence
  Description of Artificial Sequence: Synthetic peptide
AGLLR

SEQ ID NO: 2528 - protein, 5 aa, Artificial Sequence
  Description of Artificial Sequence: Synthetic peptide
GGLIR

SEQ ID NO: 2529 - protein, 5 aa, Artificial Sequence
  Description of Artificial Sequence: Synthetic peptide
DGLHR

SEQ ID NO: 2530 - protein, 5 aa, Artificial Sequence
  Description of Artificial Sequence: Synthetic peptide
DTLRR

SEQ ID NO: 2531 - protein, 5 aa, Artificial Sequence
  Description of Artificial Sequence: Synthetic peptide
HLLKR

SEQ ID NO: 2532 - protein, 5 aa, Artificial Sequence
  Description of Artificial Sequence: Synthetic peptide
SALAR

SEQ ID NO: 2533 - protein, 5 aa, Artificial Sequence
  Description of Artificial Sequence: Synthetic peptide
SMLAR

SEQ ID NO: 2534 - protein, 5 aa, Artificial Sequence
  Description of Artificial Sequence: Synthetic peptide
VGLKR

SEQ ID NO: 2535 - protein, 5 aa, Artificial Sequence
  Description of Artificial Sequence: Synthetic peptide
DNLLR

SEQ ID NO: 2536 - protein, 5 aa, Artificial Sequence
  Description of Artificial Sequence: Synthetic peptide
GGLMR

SEQ ID NO: 2537 - protein, 5 aa, Artificial Sequence
  Description of Artificial Sequence: Synthetic peptide
SGLMR

SEQ ID NO: 2538 - protein, 5 aa, Artificial Sequence
  Description of Artificial Sequence: Synthetic peptide
AALRR

SEQ ID NO: 2539 - protein, 5 aa, Artificial Sequence
  Description of Artificial Sequence: Synthetic peptide
ETLRR

SEQ ID NO: 2540 - protein, 5 aa, Artificial Sequence
  Description of Artificial Sequence: Synthetic peptide
NGLAR

SEQ ID NO: 2541 - protein, 5 aa, Artificial Sequence
  Description of Artificial Sequence: Synthetic peptide
TNLQR

SEQ ID NO: 2542 - protein, 5 aa, Artificial Sequence
  Description of Artificial Sequence: Synthetic peptide
ANLAR

SEQ ID NO: 2543 - protein, 5 aa, Artificial Sequence
  Description of Artificial Sequence: Synthetic peptide
NNLAR

SEQ ID NO: 2544 - protein, 5 aa, Artificial Sequence
  Description of Artificial Sequence: Synthetic peptide
SNLSR

SEQ ID NO: 2545 - protein, 5 aa, Artificial Sequence
  Description of Artificial Sequence: Synthetic peptide
STLSR

SEQ ID NO: 2546 - protein, 5 aa, Artificial Sequence
  Description of Artificial Sequence: Synthetic peptide
AALAR

SEQ ID NO: 2547 - protein, 5 aa, Artificial Sequence
  Description of Artificial Sequence: Synthetic peptide
HALVR

SEQ ID NO: 2548 - protein, 5 aa, Artificial Sequence
  Description of Artificial Sequence: Synthetic peptide
HGLSR

SEQ ID NO: 2549 - protein, 5 aa, Artificial Sequence
  Description of Artificial Sequence: Synthetic peptide
SGLNR

SEQ ID NO: 2550 - protein, 5 aa, Artificial Sequence
  Description of Artificial Sequence: Synthetic peptide
STLAR

SEQ ID NO: 2551 - protein, 5 aa, Artificial Sequence
  Description of Artificial Sequence: Synthetic peptide
ANLIR

SEQ ID NO: 2552 - protein, 5 aa, Artificial Sequence
  Description of Artificial Sequence: Synthetic peptide
DGLDR

SEQ ID NO: 2553 - protein, 5 aa, Artificial Sequence
  Description of Artificial Sequence: Synthetic peptide
DGLSR

SEQ ID NO: 2554 - protein, 5 aa, Artificial Sequence
  Description of Artificial Sequence: Synthetic peptide
GTLKR

SEQ ID NO: 2555 - protein, 5 aa, Artificial Sequence
  Description of Artificial Sequence: Synthetic peptide
NGLSR

SEQ ID NO: 2556 - protein, 5 aa, Artificial Sequence
  Description of Artificial Sequence: Synthetic peptide
SMLRR

SEQ ID NO: 2557 - protein, 5 aa, Artificial Sequence
  Description of Artificial Sequence: Synthetic peptide
HNLHR

SEQ ID NO: 2558 - protein, 5 aa, Artificial Sequence
  Description of Artificial Sequence: Synthetic peptide
HNLRR

SEQ ID NO: 2559 - protein, 5 aa, Artificial Sequence
  Description of Artificial Sequence: Synthetic peptide
SGLKR

SEQ ID NO: 2560 - protein, 5 aa, Artificial Sequence
  Description of Artificial Sequence: Synthetic peptide
TGLGR

SEQ ID NO: 2561 - protein, 5 aa, Artificial Sequence
  Description of Artificial Sequence: Synthetic peptide
TNLMR

SEQ ID NO: 2562 - protein, 5 aa, Artificial Sequence
  Description of Artificial Sequence: Synthetic peptide
GTLTR

SEQ ID NO: 2563 - protein, 5 aa, Artificial Sequence
  Description of Artificial Sequence: Synthetic peptide
DGLNR

SEQ ID NO: 2564 - protein, 5 aa, Artificial Sequence
  Description of Artificial Sequence: Synthetic peptide
SSLVR

SEQ ID NO: 2565 - protein, 5 aa, Artificial Sequence
  Description of Artificial Sequence: Synthetic peptide
TGLER

SEQ ID NO: 2566 - protein, 5 aa, Artificial Sequence
  Description of Artificial Sequence: Synthetic peptide
DTLKR

SEQ ID NO: 2567 - protein, 5 aa, Artificial Sequence
  Description of Artificial Sequence: Synthetic peptide
GNLSR

SEQ ID NO: 2568 - protein, 5 aa, Artificial Sequence
  Description of Artificial Sequence: Synthetic peptide
HSLVR

SEQ ID NO: 2569 - protein, 5 aa, Artificial Sequence
  Description of Artificial Sequence: Synthetic peptide
AGLNR

SEQ ID NO: 2570 - protein, 5 aa, Artificial Sequence
  Description of Artificial Sequence: Synthetic peptide
DALAR

SEQ ID NO: 2571 - protein, 5 aa, Artificial Sequence
  Description of Artificial Sequence: Synthetic peptide
GGLHR

SEQ ID NO: 2572 - protein, 5 aa, Artificial Sequence
  Description of Artificial Sequence: Synthetic peptide
NGLIR

SEQ ID NO: 2573 - protein, 5 aa, Artificial Sequence
  Description of Artificial Sequence: Synthetic peptide
QGLTR

SEQ ID NO: 2574 - protein, 5 aa, Artificial Sequence
  Description of Artificial Sequence: Synthetic peptide
QMLKR

SEQ ID NO: 2575 - protein, 5 aa, Artificial Sequence
  Description of Artificial Sequence: Synthetic peptide
QNLRR

SEQ ID NO: 2576 - protein, 5 aa, Artificial Sequence
  Description of Artificial Sequence: Synthetic peptide
AILKR

SEQ ID NO: 2577 - protein, 5 aa, Artificial Sequence
  Description of Artificial Sequence: Synthetic peptide
HNLTR

SEQ ID NO: 2578 - protein, 5 aa, Artificial Sequence
  Description of Artificial Sequence: Synthetic peptide
HTLAR

SEQ ID NO: 2579 - protein, 5 aa, Artificial Sequence
  Description of Artificial Sequence: Synthetic peptide
QGLKR

SEQ ID NO: 2580 - protein, 5 aa, Artificial Sequence
  Description of Artificial Sequence: Synthetic peptide
SGLER

SEQ ID NO: 2581 - protein, 5 aa, Artificial Sequence
  Description of Artificial Sequence: Synthetic peptide
SGLGR

SEQ ID NO: 2582 - protein, 5 aa, Artificial Sequence
  Description of Artificial Sequence: Synthetic peptide
SNLVR

SEQ ID NO: 2583 - protein, 5 aa, Artificial Sequence
  Description of Artificial Sequence: Synthetic peptide
EALRR

SEQ ID NO: 2584 - protein, 5 aa, Artificial Sequence
  Description of Artificial Sequence: Synthetic peptide
GTLRR

SEQ ID NO: 2585 - protein, 5 aa, Artificial Sequence
  Description of Artificial Sequence: Synthetic peptide
HGLGR

SEQ ID NO: 2586 - protein, 5 aa, Artificial Sequence
  Description of Artificial Sequence: Synthetic peptide
HTLMR

SEQ ID NO: 2587 - protein, 5 aa, Artificial Sequence
  Description of Artificial Sequence: Synthetic peptide
NTLRR

SEQ ID NO: 2588 - protein, 5 aa, Artificial Sequence
  Description of Artificial Sequence: Synthetic peptide
TGLHR

SEQ ID NO: 2589 - protein, 5 aa, Artificial Sequence
  Description of Artificial Sequence: Synthetic peptide
TSLRR

SEQ ID NO: 2590 - protein, 5 aa, Artificial Sequence
  Description of Artificial Sequence: Synthetic peptide
TTLQR

SEQ ID NO: 2591 - protein, 5 aa, Artificial Sequence
  Description of Artificial Sequence: Synthetic peptide
DNLKR

SEQ ID NO: 2592 - protein, 5 aa, Artificial Sequence
  Description of Artificial Sequence: Synthetic peptide
GALTR

SEQ ID NO: 2593 - protein, 5 aa, Artificial Sequence
  Description of Artificial Sequence: Synthetic peptide
QTLRR

SEQ ID NO: 2594 - protein, 5 aa, Artificial Sequence
  Description of Artificial Sequence: Synthetic peptide
SGLIR

SEQ ID NO: 2595 - protein, 5 aa, Artificial Sequence
  Description of Artificial Sequence: Synthetic peptide
TNLKR

SEQ ID NO: 2596 - protein, 5 aa, Artificial Sequence
  Description of Artificial Sequence: Synthetic peptide
DGLGR

SEQ ID NO: 2597 - protein, 5 aa, Artificial Sequence
  Description of Artificial Sequence: Synthetic peptide
DSLQR

SEQ ID NO: 2598 - protein, 5 aa, Artificial Sequence
  Description of Artificial Sequence: Synthetic peptide
EGLNR

SEQ ID NO: 2599 - protein, 5 aa, Artificial Sequence
  Description of Artificial Sequence: Synthetic peptide
ENLRR

SEQ ID NO: 2600 - protein, 5 aa, Artificial Sequence
  Description of Artificial Sequence: Synthetic peptide
GSLRR

SEQ ID NO: 2601 - protein, 5 aa, Artificial Sequence
  Description of Artificial Sequence: Synthetic peptide
NGLNR

SEQ ID NO: 2602 - protein, 5 aa, Artificial Sequence
  Description of Artificial Sequence: Synthetic peptide
QALKR

SEQ ID NO: 2603 - protein, 5 aa, Artificial Sequence
  Description of Artificial Sequence: Synthetic peptide
SALSR

SEQ ID NO: 2604 - protein, 5 aa, Artificial Sequence
  Description of Artificial Sequence: Synthetic peptide
SSLGR

SEQ ID NO: 2605 - protein, 5 aa, Artificial Sequence
  Description of Artificial Sequence: Synthetic peptide
VNLKR

SEQ ID NO: 2606 - protein, 5 aa, Artificial Sequence
  Description of Artificial Sequence: Synthetic peptide
EMLKR

SEQ ID NO: 2607 - protein, 5 aa, Artificial Sequence
  Description of Artificial Sequence: Synthetic peptide
GALVR

SEQ ID NO: 2608 - protein, 5 aa, Artificial Sequence
  Description of Artificial Sequence: Synthetic peptide
GNLGR

SEQ ID NO: 2609 - protein, 5 aa, Artificial Sequence
  Description of Artificial Sequence: Synthetic peptide
GNLQR

SEQ ID NO: 2610 - protein, 5 aa, Artificial Sequence
  Description of Artificial Sequence: Synthetic peptide
HALAR

SEQ ID NO: 2611 - protein, 5 aa, Artificial Sequence
  Description of Artificial Sequence: Synthetic peptide
HSLIR

SEQ ID NO: 2612 - protein, 5 aa, Artificial Sequence
  Description of Artificial Sequence: Synthetic peptide
HTLER

SEQ ID NO: 2613 - protein, 5 aa, Artificial Sequence
  Description of Artificial Sequence: Synthetic peptide
HTLQR

SEQ ID NO: 2614 - protein, 5 aa, Artificial Sequence
  Description of Artificial Sequence: Synthetic peptide
NGLER

SEQ ID NO: 2615 - protein, 5 aa, Artificial Sequence
  Description of Artificial Sequence: Synthetic peptide
NGLMR

SEQ ID NO: 2616 - protein, 5 aa, Artificial Sequence
  Description of Artificial Sequence: Synthetic peptide
QGLVR

SEQ ID NO: 2617 - protein, 5 aa, Artificial Sequence
  Description of Artificial Sequence: Synthetic peptide
TALKR

SEQ ID NO: 2618 - protein, 5 aa, Artificial Sequence
  Description of Artificial Sequence: Synthetic peptide
TTLMR

SEQ ID NO: 2619 - protein, 5 aa, Artificial Sequence
  Description of Artificial Sequence: Synthetic peptide
VGLRR

SEQ ID NO: 2620 - protein, 5 aa, Artificial Sequence
  Description of Artificial Sequence: Synthetic peptide
ANLKR

SEQ ID NO: 2621 - protein, 5 aa, Artificial Sequence
  Description of Artificial Sequence: Synthetic peptide
ANLNR

SEQ ID NO: 2622 - protein, 5 aa, Artificial Sequence
  Description of Artificial Sequence: Synthetic peptide
ATLTR

SEQ ID NO: 2623 - protein, 5 aa, Artificial Sequence
  Description of Artificial Sequence: Synthetic peptide
DNLRR

SEQ ID NO: 2624 - protein, 5 aa, Artificial Sequence
  Description of Artificial Sequence: Synthetic peptide
ENLKR

SEQ ID NO: 2625 - protein, 5 aa, Artificial Sequence
  Description of Artificial Sequence: Synthetic peptide
GGLLR

SEQ ID NO: 2626 - protein, 5 aa, Artificial Sequence
  Description of Artificial Sequence: Synthetic peptide
GTLVR

SEQ ID NO: 2627 - protein, 5 aa, Artificial Sequence
  Description of Artificial Sequence: Synthetic peptide
HNLSR

SEQ ID NO: 2628 - protein, 5 aa, Artificial Sequence
  Description of Artificial Sequence: Synthetic peptide
NTLKR

SEQ ID NO: 2629 - protein, 5 aa, Artificial Sequence
  Description of Artificial Sequence: Synthetic peptide
SALER

SEQ ID NO: 2630 - protein, 5 aa, Artificial Sequence
  Description of Artificial Sequence: Synthetic peptide
SSLTR

SEQ ID NO: 2631 - protein, 5 aa, Artificial Sequence
  Description of Artificial Sequence: Synthetic peptide
TALVR

SEQ ID NO: 2632 - protein, 5 aa, Artificial Sequence
  Description of Artificial Sequence: Synthetic peptide
DNLAR

SEQ ID NO: 2633 - protein, 5 aa, Artificial Sequence
  Description of Artificial Sequence: Synthetic peptide
ENLSR

SEQ ID NO: 2634 - protein, 5 aa, Artificial Sequence
  Description of Artificial Sequence: Synthetic peptide
ESLRR

SEQ ID NO: 2635 - protein, 5 aa, Artificial Sequence
  Description of Artificial Sequence: Synthetic peptide
NALRR

SEQ ID NO: 2636 - protein, 5 aa, Artificial Sequence
  Description of Artificial Sequence: Synthetic peptide
NGLKR

SEQ ID NO: 2637 - protein, 5 aa, Artificial Sequence
  Description of Artificial Sequence: Synthetic peptide
NNLLR

SEQ ID NO: 2638 - protein, 5 aa, Artificial Sequence
  Description of Artificial Sequence: Synthetic peptide
STLRR

SEQ ID NO: 2639 - protein, 5 aa, Artificial Sequence
  Description of Artificial Sequence: Synthetic peptide
VNLSR

SEQ ID NO: 2640 - protein, 5 aa, Artificial Sequence
  Description of Artificial Sequence: Synthetic peptide
DMLKR

SEQ ID NO: 2641 - protein, 5 aa, Artificial Sequence
  Description of Artificial Sequence: Synthetic peptide
GALRR

SEQ ID NO: 2642 - protein, 5 aa, Artificial Sequence
  Description of Artificial Sequence: Synthetic peptide
GGLDR

SEQ ID NO: 2643 - protein, 5 aa, Artificial Sequence
  Description of Artificial Sequence: Synthetic peptide
HGLMR

SEQ ID NO: 2644 - protein, 5 aa, Artificial Sequence
  Description of Artificial Sequence: Synthetic peptide
HNLVR

SEQ ID NO: 2645 - protein, 5 aa, Artificial Sequence
  Description of Artificial Sequence: Synthetic peptide
HQLIR

SEQ ID NO: 2646 - protein, 5 aa, Artificial Sequence
  Description of Artificial Sequence: Synthetic peptide
QNLQR

SEQ ID NO: 2647 - protein, 5 aa, Artificial Sequence
  Description of Artificial Sequence: Synthetic peptide
SMLIR

SEQ ID NO: 2648 - protein, 5 aa, Artificial Sequence
  Description of Artificial Sequence: Synthetic peptide
TALRV

SEQ ID NO: 2649 - protein, 5 aa, Artificial Sequence
  Description of Artificial Sequence: Synthetic peptide
TNLAR

SEQ ID NO: 2650 - protein, 5 aa, Artificial Sequence
  Description of Artificial Sequence: Synthetic peptide
TQLKR

SEQ ID NO: 2651 - protein, 5 aa, Artificial Sequence
  Description of Artificial Sequence: Synthetic peptide
TTLTR

SEQ ID NO: 2652 - protein, 5 aa, Artificial Sequence
  Description of Artificial Sequence: Synthetic peptide
VGLQR

SEQ ID NO: 2653 - protein, 5 aa, Artificial Sequence
  Description of Artificial Sequence: Synthetic peptide
AALSR

SEQ ID NO: 2654 - protein, 5 aa, Artificial Sequence
  Description of Artificial Sequence: Synthetic peptide
ATLAR

SEQ ID NO: 2655 - protein, 5 aa, Artificial Sequence
  Description of Artificial Sequence: Synthetic peptide
DALGR

SEQ ID NO: 2656 - protein, 5 aa, Artificial Sequence
  Description of Artificial Sequence: Synthetic peptide
DTLNR

SEQ ID NO: 2657 - protein, 5 aa, Artificial Sequence
  Description of Artificial Sequence: Synthetic peptide
EILKR

SEQ ID NO: 2658 - protein, 5 aa, Artificial Sequence
  Description of Artificial Sequence: Synthetic peptide
ESLKR

SEQ ID NO: 2659 - protein, 5 aa, Artificial Sequence
  Description of Artificial Sequence: Synthetic peptide
GGLNR

SEQ ID NO: 2660 - protein, 5 aa, Artificial Sequence
  Description of Artificial Sequence: Synthetic peptide
GSLTR

SEQ ID NO: 2661 - protein, 5 aa, Artificial Sequence
  Description of Artificial Sequence: Synthetic peptide
HNLAR

SEQ ID NO: 2662 - protein, 5 aa, Artificial Sequence
  Description of Artificial Sequence: Synthetic peptide
MGLKR

SEQ ID NO: 2663 - protein, 5 aa, Artificial Sequence
  Description of Artificial Sequence: Synthetic peptide
NGLHR

SEQ ID NO: 2664 - protein, 5 aa, Artificial Sequence
  Description of Artificial Sequence: Synthetic peptide
NMLKR

SEQ ID NO: 2665 - protein, 5 aa, Artificial Sequence
  Description of Artificial Sequence: Synthetic peptide
PNLKR

SEQ ID NO: 2666 - protein, 5 aa, Artificial Sequence
  Description of Artificial Sequence: Synthetic peptide
SALTR

SEQ ID NO: 2667 - protein, 5 aa, Artificial Sequence
  Description of Artificial Sequence: Synthetic peptide
SDLKR

SEQ ID NO: 2668 - protein, 5 aa, Artificial Sequence
  Description of Artificial Sequence: Synthetic peptide
STLGR

SEQ ID NO: 2669 - protein, 5 aa, Artificial Sequence
  Description of Artificial Sequence: Synthetic peptide
AGLER

SEQ ID NO: 2670 - protein, 5 aa, Artificial Sequence
  Description of Artificial Sequence: Synthetic peptide
DILRR

SEQ ID NO: 2671 - protein, 5 aa, Artificial Sequence
  Description of Artificial Sequence: Synthetic peptide
DMLNR

SEQ ID NO: 2672 - protein, 5 aa, Artificial Sequence
  Description of Artificial Sequence: Synthetic peptide
DTLAR

SEQ ID NO: 2673 - protein, 5 aa, Artificial Sequence
  Description of Artificial Sequence: Synthetic peptide
HALLR

SEQ ID NO: 2674 - protein, 5 aa, Artificial Sequence
  Description of Artificial Sequence: Synthetic peptide
HALSR

SEQ ID NO: 2675 - protein, 5 aa, Artificial Sequence
  Description of Artificial Sequence: Synthetic peptide
HNLGR

SEQ ID NO: 2676 - protein, 5 aa, Artificial Sequence
  Description of Artificial Sequence: Synthetic peptide
NALVR

SEQ ID NO: 2677 - protein, 5 aa, Artificial Sequence
  Description of Artificial Sequence: Synthetic peptide
SMLTR

SEQ ID NO: 2678 - protein, 5 aa, Artificial Sequence
  Description of Artificial Sequence: Synthetic peptide
TALAR

SEQ ID NO: 2679 - protein, 5 aa, Artificial Sequence
  Description of Artificial Sequence: Synthetic peptide
TNLER

SEQ ID NO: 2680 - protein, 5 aa, Artificial Sequence
  Description of Artificial Sequence: Synthetic peptide
TNLGR

SEQ ID NO: 2681 - protein, 5 aa, Artificial Sequence
  Description of Artificial Sequence: Synthetic peptide
TTLNR

SEQ ID NO: 2682 - protein, 5 aa, Artificial Sequence
  Description of Artificial Sequence: Synthetic peptide
DALLR

SEQ ID NO: 2683 - protein, 5 aa, Artificial Sequence
  Description of Artificial Sequence: Synthetic peptide
DSLAR

SEQ ID NO: 2684 - protein, 5 aa, Artificial Sequence
  Description of Artificial Sequence: Synthetic peptide
GTLAR

SEQ ID NO: 2685 - protein, 5 aa, Artificial Sequence
  Description of Artificial Sequence: Synthetic peptide
GTLLV

SEQ ID NO: 2686 - protein, 5 aa, Artificial Sequence
  Description of Artificial Sequence: Synthetic peptide
HALIR

SEQ ID NO: 2687 - protein, 5 aa, Artificial Sequence
  Description of Artificial Sequence: Synthetic peptide
HGLDR

SEQ ID NO: 2688 - protein, 5 aa, Artificial Sequence
  Description of Artificial Sequence: Synthetic peptide
HGLER

SEQ ID NO: 2689 - protein, 5 aa, Artificial Sequence
  Description of Artificial Sequence: Synthetic peptide
HTLLR

SEQ ID NO: 2690 - protein, 5 aa, Artificial Sequence
  Description of Artificial Sequence: Synthetic peptide
NNLIR

SEQ ID NO: 2691 - protein, 5 aa, Artificial Sequence
  Description of Artificial Sequence: Synthetic peptide
NNLMR

SEQ ID NO: 2692 - protein, 5 aa, Artificial Sequence
  Description of Artificial Sequence: Synthetic peptide
QSLKR

SEQ ID NO: 2693 - protein, 5 aa, Artificial Sequence
  Description of Artificial Sequence: Synthetic peptide
SALGR

SEQ ID NO: 2694 - protein, 5 aa, Artificial Sequence
  Description of Artificial Sequence: Synthetic peptide
SALVR

SEQ ID NO: 2695 - protein, 5 aa, Artificial Sequence
  Description of Artificial Sequence: Synthetic peptide
SNLMR

SEQ ID NO: 2696 - protein, 5 aa, Artificial Sequence
  Description of Artificial Sequence: Synthetic peptide
SQLRR

SEQ ID NO: 2697 - protein, 5 aa, Artificial Sequence
  Description of Artificial Sequence: Synthetic peptide
STLQR

SEQ ID NO: 2698 - protein, 5 aa, Artificial Sequence
  Description of Artificial Sequence: Synthetic peptide
STLVR

SEQ ID NO: 2699 - protein, 5 aa, Artificial Sequence
  Description of Artificial Sequence: Synthetic peptide
SVLKR

SEQ ID NO: 2700 - protein, 5 aa, Artificial Sequence
  Description of Artificial Sequence: Synthetic peptide
AALTR

SEQ ID NO: 2701 - protein, 5 aa, Artificial Sequence
  Description of Artificial Sequence: Synthetic peptide
DSLKR

SEQ ID NO: 2702 - protein, 5 aa, Artificial Sequence
  Description of Artificial Sequence: Synthetic peptide
DSLRR

SEQ ID NO: 2703 - protein, 5 aa, Artificial Sequence
  Description of Artificial Sequence: Synthetic peptide
DTLMR

SEQ ID NO: 2704 - protein, 5 aa, Artificial Sequence
  Description of Artificial Sequence: Synthetic peptide
EGLLR

SEQ ID NO: 2705 - protein, 5 aa, Artificial Sequence
  Description of Artificial Sequence: Synthetic peptide
ENLAR

SEQ ID NO: 2706 - protein, 5 aa, Artificial Sequence
  Description of Artificial Sequence: Synthetic peptide
GNLNR

SEQ ID NO: 2707 - protein, 5 aa, Artificial Sequence
  Description of Artificial Sequence: Synthetic peptide
GTLQR

SEQ ID NO: 2708 - protein, 5 aa, Artificial Sequence
  Description of Artificial Sequence: Synthetic peptide
HALDR

SEQ ID NO: 2709 - protein, 5 aa, Artificial Sequence
  Description of Artificial Sequence: Synthetic peptide
HVLER

SEQ ID NO: 2710 - protein, 5 aa, Artificial Sequence
  Description of Artificial Sequence: Synthetic peptide
IGLRR

SEQ ID NO: 2711 - protein, 5 aa, Artificial Sequence
  Description of Artificial Sequence: Synthetic peptide
INLTR

SEQ ID NO: 2712 - protein, 5 aa, Artificial Sequence
  Description of Artificial Sequence: Synthetic peptide
NMLRR

SEQ ID NO: 2713 - protein, 5 aa, Artificial Sequence
  Description of Artificial Sequence: Synthetic peptide
QMLRR

SEQ ID NO: 2714 - protein, 5 aa, Artificial Sequence
  Description of Artificial Sequence: Synthetic peptide
TNLHR

SEQ ID NO: 2715 - protein, 5 aa, Artificial Sequence
  Description of Artificial Sequence: Synthetic peptide
TSLHR

SEQ ID NO: 2716 - protein, 5 aa, Artificial Sequence
  Description of Artificial Sequence: Synthetic peptide
VGLAR

SEQ ID NO: 2717 - protein, 5 aa, Artificial Sequence
  Description of Artificial Sequence: Synthetic peptide
AALQR

SEQ ID NO: 2718 - protein, 5 aa, Artificial Sequence
  Description of Artificial Sequence: Synthetic peptide
AGLDR

SEQ ID NO: 2719 - protein, 5 aa, Artificial Sequence
  Description of Artificial Sequence: Synthetic peptide
DTLQR

SEQ ID NO: 2720 - protein, 5 aa, Artificial Sequence
  Description of Artificial Sequence: Synthetic peptide
DVLKR

SEQ ID NO: 2721 - protein, 5 aa, Artificial Sequence
  Description of Artificial Sequence: Synthetic peptide
GALSR

SEQ ID NO: 2722 - protein, 5 aa, Artificial Sequence
  Description of Artificial Sequence: Synthetic peptide
GMLKR

SEQ ID NO: 2723 - protein, 5 aa, Artificial Sequence
  Description of Artificial Sequence: Synthetic peptide
GTLSR

SEQ ID NO: 2724 - protein, 5 aa, Artificial Sequence
  Description of Artificial Sequence: Synthetic peptide
HNLER

SEQ ID NO: 2725 - protein, 5 aa, Artificial Sequence
  Description of Artificial Sequence: Synthetic peptide
NGLLV

SEQ ID NO: 2726 - protein, 5 aa, Artificial Sequence
  Description of Artificial Sequence: Synthetic peptide
NNLTR

SEQ ID NO: 2727 - protein, 5 aa, Artificial Sequence
  Description of Artificial Sequence: Synthetic peptide
QALAV

SEQ ID NO: 2728 - protein, 5 aa, Artificial Sequence
  Description of Artificial Sequence: Synthetic peptide
QGLAR

SEQ ID NO: 2729 - protein, 5 aa, Artificial Sequence
  Description of Artificial Sequence: Synthetic peptide
QNLHR

SEQ ID NO: 2730 - protein, 5 aa, Artificial Sequence
  Description of Artificial Sequence: Synthetic peptide
SALMR

SEQ ID NO: 2731 - protein, 5 aa, Artificial Sequence
  Description of Artificial Sequence: Synthetic peptide
SLLLR

SEQ ID NO: 2732 - protein, 5 aa, Artificial Sequence
  Description of Artificial Sequence: Synthetic peptide
SVLAR

SEQ ID NO: 2733 - protein, 5 aa, Artificial Sequence
  Description of Artificial Sequence: Synthetic peptide
SVLTR

SEQ ID NO: 2734 - protein, 5 aa, Artificial Sequence
  Description of Artificial Sequence: Synthetic peptide
TALRR

SEQ ID NO: 2735 - protein, 5 aa, Artificial Sequence
  Description of Artificial Sequence: Synthetic peptide
TQLRV

SEQ ID NO: 2736 - protein, 5 aa, Artificial Sequence
  Description of Artificial Sequence: Synthetic peptide
TTLLR

SEQ ID NO: 2737 - protein, 5 aa, Artificial Sequence
  Description of Artificial Sequence: Synthetic peptide
TTLRR

SEQ ID NO: 2738 - protein, 5 aa, Artificial Sequence
  Description of Artificial Sequence: Synthetic peptide
AALNR

SEQ ID NO: 2739 - protein, 5 aa, Artificial Sequence
  Description of Artificial Sequence: Synthetic peptide
ATLVR

SEQ ID NO: 2740 - protein, 5 aa, Artificial Sequence
  Description of Artificial Sequence: Synthetic peptide
DALHR

SEQ ID NO: 2741 - protein, 5 aa, Artificial Sequence
  Description of Artificial Sequence: Synthetic peptide
DALMR

SEQ ID NO: 2742 - protein, 5 aa, Artificial Sequence
  Description of Artificial Sequence: Synthetic peptide
DGLER

SEQ ID NO: 2743 - protein, 5 aa, Artificial Sequence
  Description of Artificial Sequence: Synthetic peptide
DGLQR

SEQ ID NO: 2744 - protein, 5 aa, Artificial Sequence
  Description of Artificial Sequence: Synthetic peptide
DLLRR

SEQ ID NO: 2745 - protein, 5 aa, Artificial Sequence
  Description of Artificial Sequence: Synthetic peptide
GGLGR

SEQ ID NO: 2746 - protein, 5 aa, Artificial Sequence
  Description of Artificial Sequence: Synthetic peptide
GNLHR

SEQ ID NO: 2747 - protein, 5 aa, Artificial Sequence
  Description of Artificial Sequence: Synthetic peptide
GTLNR

SEQ ID NO: 2748 - protein, 5 aa, Artificial Sequence
  Description of Artificial Sequence: Synthetic peptide
HALHR

SEQ ID NO: 2749 - protein, 5 aa, Artificial Sequence
  Description of Artificial Sequence: Synthetic peptide
HALMR

SEQ ID NO: 2750 - protein, 5 aa, Artificial Sequence
  Description of Artificial Sequence: Synthetic peptide
HILTR

SEQ ID NO: 2751 - protein, 5 aa, Artificial Sequence
  Description of Artificial Sequence: Synthetic peptide
HLLLR

SEQ ID NO: 2752 - protein, 5 aa, Artificial Sequence
  Description of Artificial Sequence: Synthetic peptide
HNLQR

SEQ ID NO: 2753 - protein, 5 aa, Artificial Sequence
  Description of Artificial Sequence: Synthetic peptide
HTLGR

SEQ ID NO: 2754 - protein, 5 aa, Artificial Sequence
  Description of Artificial Sequence: Synthetic peptide
IGLTG

SEQ ID NO: 2755 - protein, 5 aa, Artificial Sequence
  Description of Artificial Sequence: Synthetic peptide
NGLLR

SEQ ID NO: 2756 - protein, 5 aa, Artificial Sequence
  Description of Artificial Sequence: Synthetic peptide
NSLRR

SEQ ID NO: 2757 - protein, 5 aa, Artificial Sequence
  Description of Artificial Sequence: Synthetic peptide
PNLIR

SEQ ID NO: 2758 - protein, 5 aa, Artificial Sequence
  Description of Artificial Sequence: Synthetic peptide
PNLRR

SEQ ID NO: 2759 - protein, 5 aa, Artificial Sequence
  Description of Artificial Sequence: Synthetic peptide
SALIR

SEQ ID NO: 2760 - protein, 5 aa, Artificial Sequence
  Description of Artificial Sequence: Synthetic peptide
SILGR

SEQ ID NO: 2761 - protein, 5 aa, Artificial Sequence
  Description of Artificial Sequence: Synthetic peptide
SPLVR

SEQ ID NO: 2762 - protein, 5 aa, Artificial Sequence
  Description of Artificial Sequence: Synthetic peptide
STLTR

SEQ ID NO: 2763 - protein, 5 aa, Artificial Sequence
  Description of Artificial Sequence: Synthetic peptide
TALKT

SEQ ID NO: 2764 - protein, 5 aa, Artificial Sequence
  Description of Artificial Sequence: Synthetic peptide
TALTR

SEQ ID NO: 2765 - protein, 5 aa, Artificial Sequence
  Description of Artificial Sequence: Synthetic peptide
TGLDR

SEQ ID NO: 2766 - protein, 5 aa, Artificial Sequence
  Description of Artificial Sequence: Synthetic peptide
TSLKR

SEQ ID NO: 2767 - protein, 5 aa, Artificial Sequence
  Description of Artificial Sequence: Synthetic peptide
TTLVR

SEQ ID NO: 2768 - protein, 5 aa, Artificial Sequence
  Description of Artificial Sequence: Synthetic peptide
VGLQN

SEQ ID NO: 2769 - protein, 5 aa, Artificial Sequence
  Description of Artificial Sequence: Synthetic peptide
VNLRR

SEQ ID NO: 2770 - protein, 5 aa, Artificial Sequence
  Description of Artificial Sequence: Synthetic peptide
AALVR

SEQ ID NO: 2771 - protein, 5 aa, Artificial Sequence
  Description of Artificial Sequence: Synthetic peptide
ANLGR

SEQ ID NO: 2772 - protein, 5 aa, Artificial Sequence
  Description of Artificial Sequence: Synthetic peptide
ATLSR

SEQ ID NO: 2773 - protein, 5 aa, Artificial Sequence
  Description of Artificial Sequence: Synthetic peptide
DNLQR

SEQ ID NO: 2774 - protein, 5 aa, Artificial Sequence
  Description of Artificial Sequence: Synthetic peptide
DNLTR

SEQ ID NO: 2775 - protein, 5 aa, Artificial Sequence
  Description of Artificial Sequence: Synthetic peptide
DRLRR

SEQ ID NO: 2776 - protein, 5 aa, Artificial Sequence
  Description of Artificial Sequence: Synthetic peptide
DTLVR

SEQ ID NO: 2777 - protein, 5 aa, Artificial Sequence
  Description of Artificial Sequence: Synthetic peptide
EGLVR

SEQ ID NO: 2778 - protein, 5 aa, Artificial Sequence
  Description of Artificial Sequence: Synthetic peptide
GALNR

SEQ ID NO: 2779 - protein, 5 aa, Artificial Sequence
  Description of Artificial Sequence: Synthetic peptide
GDLKR

SEQ ID NO: 2780 - protein, 5 aa, Artificial Sequence
  Description of Artificial Sequence: Synthetic peptide
GDLTR

SEQ ID NO: 2781 - protein, 5 aa, Artificial Sequence
  Description of Artificial Sequence: Synthetic peptide
GSLQR

SEQ ID NO: 2782 - protein, 5 aa, Artificial Sequence
  Description of Artificial Sequence: Synthetic peptide
HGLHR

SEQ ID NO: 2783 - protein, 5 aa, Artificial Sequence
  Description of Artificial Sequence: Synthetic peptide
HTLKR

SEQ ID NO: 2784 - protein, 5 aa, Artificial Sequence
  Description of Artificial Sequence: Synthetic peptide
HVLKR

SEQ ID NO: 2785 - protein, 5 aa, Artificial Sequence
  Description of Artificial Sequence: Synthetic peptide
NGLDR

SEQ ID NO: 2786 - protein, 5 aa, Artificial Sequence
  Description of Artificial Sequence: Synthetic peptide
NMLAR

SEQ ID NO: 2787 - protein, 5 aa, Artificial Sequence
  Description of Artificial Sequence: Synthetic peptide
NSLAR

SEQ ID NO: 2788 - protein, 5 aa, Artificial Sequence
  Description of Artificial Sequence: Synthetic peptide
NTLAR

SEQ ID NO: 2789 - protein, 5 aa, Artificial Sequence
  Description of Artificial Sequence: Synthetic peptide
QGLHR

SEQ ID NO: 2790 - protein, 5 aa, Artificial Sequence
  Description of Artificial Sequence: Synthetic peptide
SILTR

SEQ ID NO: 2791 - protein, 5 aa, Artificial Sequence
  Description of Artificial Sequence: Synthetic peptide
SILVR

SEQ ID NO: 2792 - protein, 5 aa, Artificial Sequence
  Description of Artificial Sequence: Synthetic peptide
SQLKR

SEQ ID NO: 2793 - protein, 5 aa, Artificial Sequence
  Description of Artificial Sequence: Synthetic peptide
SSLQR

SEQ ID NO: 2794 - protein, 5 aa, Artificial Sequence
  Description of Artificial Sequence: Synthetic peptide
TALHR

SEQ ID NO: 2795 - protein, 5 aa, Artificial Sequence
  Description of Artificial Sequence: Synthetic peptide
TALNR

SEQ ID NO: 2796 - protein, 5 aa, Artificial Sequence
  Description of Artificial Sequence: Synthetic peptide
TALSR

SEQ ID NO: 2797 - protein, 5 aa, Artificial Sequence
  Description of Artificial Sequence: Synthetic peptide
AGLGR

SEQ ID NO: 2798 - protein, 5 aa, Artificial Sequence
  Description of Artificial Sequence: Synthetic peptide
AGLMR

SEQ ID NO: 2799 - protein, 5 aa, Artificial Sequence
  Description of Artificial Sequence: Synthetic peptide
ASLQR

SEQ ID NO: 2800 - protein, 5 aa, Artificial Sequence
  Description of Artificial Sequence: Synthetic peptide
ASLVR

SEQ ID NO: 2801 - protein, 5 aa, Artificial Sequence
  Description of Artificial Sequence: Synthetic peptide
ATLMR

SEQ ID NO: 2802 - protein, 5 aa, Artificial Sequence
  Description of Artificial Sequence: Synthetic peptide
AVLKR

SEQ ID NO: 2803 - protein, 5 aa, Artificial Sequence
  Description of Artificial Sequence: Synthetic peptide
DALNR

SEQ ID NO: 2804 - protein, 5 aa, Artificial Sequence
  Description of Artificial Sequence: Synthetic peptide
DALQR

SEQ ID NO: 2805 - protein, 5 aa, Artificial Sequence
  Description of Artificial Sequence: Synthetic peptide
DALSR

SEQ ID NO: 2806 - protein, 5 aa, Artificial Sequence
  Description of Artificial Sequence: Synthetic peptide
DHLHR

SEQ ID NO: 2807 - protein, 5 aa, Artificial Sequence
  Description of Artificial Sequence: Synthetic peptide
DHLVR

SEQ ID NO: 2808 - protein, 5 aa, Artificial Sequence
  Description of Artificial Sequence: Synthetic peptide
DNLSR

SEQ ID NO: 2809 - protein, 5 aa, Artificial Sequence
  Description of Artificial Sequence: Synthetic peptide
DTLSR

SEQ ID NO: 2810 - protein, 5 aa, Artificial Sequence
  Description of Artificial Sequence: Synthetic peptide
DTLTR

SEQ ID NO: 2811 - protein, 5 aa, Artificial Sequence
  Description of Artificial Sequence: Synthetic peptide
DVLRR

SEQ ID NO: 2812 - protein, 5 aa, Artificial Sequence
  Description of Artificial Sequence: Synthetic peptide
EGLIR

SEQ ID NO: 2813 - protein, 5 aa, Artificial Sequence
  Description of Artificial Sequence: Synthetic peptide
EGLSR

SEQ ID NO: 2814 - protein, 4 aa, Artificial Sequence
  Description of Artificial Sequence: Synthetic peptide
GAEE

SEQ ID NO: 2815 - protein, 5 aa, Artificial Sequence
  Description of Artificial Sequence: Synthetic peptide
GALQR

SEQ ID NO: 2816 - protein, 5 aa, Artificial Sequence
  Description of Artificial Sequence: Synthetic peptide
GDLRR

SEQ ID NO: 2817 - protein, 5 aa, Artificial Sequence
  Description of Artificial Sequence: Synthetic peptide
GDLVR

SEQ ID NO: 2818 - protein, 5 aa, Artificial Sequence
  Description of Artificial Sequence: Synthetic peptide
GSLAR

SEQ ID NO: 2819 - protein, 5 aa, Artificial Sequence
  Description of Artificial Sequence: Synthetic peptide
GSLKR

SEQ ID NO: 2820 - protein, 5 aa, Artificial Sequence
  Description of Artificial Sequence: Synthetic peptide
HDLRR

SEQ ID NO: 2821 - protein, 5 aa, Artificial Sequence
  Description of Artificial Sequence: Synthetic peptide
HGLNR

SEQ ID NO: 2822 - protein, 5 aa, Artificial Sequence
  Description of Artificial Sequence: Synthetic peptide
HHLIR

SEQ ID NO: 2823 - protein, 5 aa, Artificial Sequence
  Description of Artificial Sequence: Synthetic peptide
HMLRR

SEQ ID NO: 2824 - protein, 5 aa, Artificial Sequence
  Description of Artificial Sequence: Synthetic peptide
HQLVR

SEQ ID NO: 2825 - protein, 5 aa, Artificial Sequence
  Description of Artificial Sequence: Synthetic peptide
HSLAR

SEQ ID NO: 2826 - protein, 5 aa, Artificial Sequence
  Description of Artificial Sequence: Synthetic peptide
HSLHR

SEQ ID NO: 2827 - protein, 5 aa, Artificial Sequence
  Description of Artificial Sequence: Synthetic peptide
HSLRR

SEQ ID NO: 2828 - protein, 5 aa, Artificial Sequence
  Description of Artificial Sequence: Synthetic peptide
HTLNR

SEQ ID NO: 2829 - protein, 5 aa, Artificial Sequence
  Description of Artificial Sequence: Synthetic peptide
HTLTR

SEQ ID NO: 2830 - protein, 5 aa, Artificial Sequence
  Description of Artificial Sequence: Synthetic peptide
HTLVR

SEQ ID NO: 2831 - protein, 5 aa, Artificial Sequence
  Description of Artificial Sequence: Synthetic peptide
IGLKR

SEQ ID NO: 2832 - protein, 5 aa, Artificial Sequence
  Description of Artificial Sequence: Synthetic peptide
ITLKR

SEQ ID NO: 2833 - protein, 5 aa, Artificial Sequence
  Description of Artificial Sequence: Synthetic peptide
MTLKR

SEQ ID NO: 2834 - protein, 5 aa, Artificial Sequence
  Description of Artificial Sequence: Synthetic peptide
NALHR

SEQ ID NO: 2835 - protein, 5 aa, Artificial Sequence
  Description of Artificial Sequence: Synthetic peptide
NALSR

SEQ ID NO: 2836 - protein, 5 aa, Artificial Sequence
  Description of Artificial Sequence: Synthetic peptide
NGLGR

SEQ ID NO: 2837 - protein, 5 aa, Artificial Sequence
  Description of Artificial Sequence: Synthetic peptide
NTLHR

SEQ ID NO: 2838 - protein, 5 aa, Artificial Sequence
  Description of Artificial Sequence: Synthetic peptide
QDLKR

SEQ ID NO: 2839 - protein, 5 aa, Artificial Sequence
  Description of Artificial Sequence: Synthetic peptide
QGLLR

SEQ ID NO: 2840 - protein, 5 aa, Artificial Sequence
  Description of Artificial Sequence: Synthetic peptide
QNLLR

SEQ ID NO: 2841 - protein, 5 aa, Artificial Sequence
  Description of Artificial Sequence: Synthetic peptide
QNLRW

SEQ ID NO: 2842 - protein, 5 aa, Artificial Sequence
  Description of Artificial Sequence: Synthetic peptide
QSLRR

SEQ ID NO: 2843 - protein, 5 aa, Artificial Sequence
  Description of Artificial Sequence: Synthetic peptide
QTLKR

SEQ ID NO: 2844 - protein, 5 aa, Artificial Sequence
  Description of Artificial Sequence: Synthetic peptide
SALRV

SEQ ID NO: 2845 - protein, 5 aa, Artificial Sequence
  Description of Artificial Sequence: Synthetic peptide
SSLAR

SEQ ID NO: 2846 - protein, 5 aa, Artificial Sequence
  Description of Artificial Sequence: Synthetic peptide
SSLSR

SEQ ID NO: 2847 - protein, 5 aa, Artificial Sequence
  Description of Artificial Sequence: Synthetic peptide
STLDR

SEQ ID NO: 2848 - protein, 5 aa, Artificial Sequence
  Description of Artificial Sequence: Synthetic peptide
STLER

SEQ ID NO: 2849 - protein, 5 aa, Artificial Sequence
  Description of Artificial Sequence: Synthetic peptide
STLHR

SEQ ID NO: 2850 - protein, 5 aa, Artificial Sequence
  Description of Artificial Sequence: Synthetic peptide
STLMR

SEQ ID NO: 2851 - protein, 5 aa, Artificial Sequence
  Description of Artificial Sequence: Synthetic peptide
TALGR

SEQ ID NO: 2852 - protein, 5 aa, Artificial Sequence
  Description of Artificial Sequence: Synthetic peptide
TGLAT

SEQ ID NO: 2853 - protein, 5 aa, Artificial Sequence
  Description of Artificial Sequence: Synthetic peptide
TGLSV

SEQ ID NO: 2854 - protein, 5 aa, Artificial Sequence
  Description of Artificial Sequence: Synthetic peptide
TGLVT

SEQ ID NO: 2855 - protein, 5 aa, Artificial Sequence
  Description of Artificial Sequence: Synthetic peptide
TNLKV

SEQ ID NO: 2856 - protein, 5 aa, Artificial Sequence
  Description of Artificial Sequence: Synthetic peptide
TNLSR

SEQ ID NO: 2857 - protein, 5 aa, Artificial Sequence
  Description of Artificial Sequence: Synthetic peptide
TTLAR

SEQ ID NO: 2858 - protein, 5 aa, Artificial Sequence
  Description of Artificial Sequence: Synthetic peptide
TTLGR

SEQ ID NO: 2859 - protein, 5 aa, Artificial Sequence
  Description of Artificial Sequence: Synthetic peptide
TTLIR

SEQ ID NO: 2860 - protein, 5 aa, Artificial Sequence
  Description of Artificial Sequence: Synthetic peptide
TTLKR

SEQ ID NO: 2861 - protein, 5 aa, Artificial Sequence
  Description of Artificial Sequence: Synthetic peptide
TVLRM

SEQ ID NO: 2862 - protein, 5 aa, Artificial Sequence
  Description of Artificial Sequence: Synthetic peptide
VQLAM

SEQ ID NO: 2863 - protein, 5 aa, Artificial Sequence
  Description of Artificial Sequence: Synthetic peptide
VTLTR

SEQ ID NO: 2864 - protein, 5 aa, Artificial Sequence
  Description of Artificial Sequence: Synthetic peptide
AALLR

SEQ ID NO: 2865 - protein, 5 aa, Artificial Sequence
  Description of Artificial Sequence: Synthetic peptide
AALMR

SEQ ID NO: 2866 - protein, 5 aa, Artificial Sequence
  Description of Artificial Sequence: Synthetic peptide
AAPER

SEQ ID NO: 2867 - protein, 5 aa, Artificial Sequence
  Description of Artificial Sequence: Synthetic peptide
ADLRR

SEQ ID NO: 2868 - protein, 5 aa, Artificial Sequence
  Description of Artificial Sequence: Synthetic peptide
AGLAW

SEQ ID NO: 2869 - protein, 5 aa, Artificial Sequence
  Description of Artificial Sequence: Synthetic peptide
AGLRW

SEQ ID NO: 2870 - protein, 5 aa, Artificial Sequence
  Description of Artificial Sequence: Synthetic peptide
AGLTS

SEQ ID NO: 2871 - protein, 5 aa, Artificial Sequence
  Description of Artificial Sequence: Synthetic peptide
AILTR

SEQ ID NO: 2872 - protein, 5 aa, Artificial Sequence
  Description of Artificial Sequence: Synthetic peptide
ANLPR

SEQ ID NO: 2873 - protein, 5 aa, Artificial Sequence
  Description of Artificial Sequence: Synthetic peptide
ARLQR

SEQ ID NO: 2874 - protein, 5 aa, Artificial Sequence
  Description of Artificial Sequence: Synthetic peptide
ARLTR

SEQ ID NO: 2875 - protein, 5 aa, Artificial Sequence
  Description of Artificial Sequence: Synthetic peptide
ASLRR

SEQ ID NO: 2876 - protein, 5 aa, Artificial Sequence
  Description of Artificial Sequence: Synthetic peptide
ASLTR

SEQ ID NO: 2877 - protein, 5 aa, Artificial Sequence
  Description of Artificial Sequence: Synthetic peptide
ATLDR

SEQ ID NO: 2878 - protein, 5 aa, Artificial Sequence
  Description of Artificial Sequence: Synthetic peptide
ATLER

SEQ ID NO: 2879 - protein, 5 aa, Artificial Sequence
  Description of Artificial Sequence: Synthetic peptide
ATLIR

SEQ ID NO: 2880 - protein, 5 aa, Artificial Sequence
  Description of Artificial Sequence: Synthetic peptide
ATLLR

SEQ ID NO: 2881 - protein, 5 aa, Artificial Sequence
  Description of Artificial Sequence: Synthetic peptide
ATLQR

SEQ ID NO: 2882 - protein, 5 aa, Artificial Sequence
  Description of Artificial Sequence: Synthetic peptide
AVLRR

SEQ ID NO: 2883 - protein, 5 aa, Artificial Sequence
  Description of Artificial Sequence: Synthetic peptide
DGLSV

SEQ ID NO: 2884 - protein, 5 aa, Artificial Sequence
  Description of Artificial Sequence: Synthetic peptide
DILHR

SEQ ID NO: 2885 - protein, 5 aa, Artificial Sequence
  Description of Artificial Sequence: Synthetic peptide
DQLRR

SEQ ID NO: 2886 - protein, 5 aa, Artificial Sequence
  Description of Artificial Sequence: Synthetic peptide
DSLSR

SEQ ID NO: 2887 - protein, 5 aa, Artificial Sequence
  Description of Artificial Sequence: Synthetic peptide
DTLAK

SEQ ID NO: 2888 - protein, 5 aa, Artificial Sequence
  Description of Artificial Sequence: Synthetic peptide
DVLLR

SEQ ID NO: 2889 - protein, 5 aa, Artificial Sequence
  Description of Artificial Sequence: Synthetic peptide
EALNR

SEQ ID NO: 2890 - protein, 5 aa, Artificial Sequence
  Description of Artificial Sequence: Synthetic peptide
EALTR

SEQ ID NO: 2891 - protein, 5 aa, Artificial Sequence
  Description of Artificial Sequence: Synthetic peptide
EGLMR

SEQ ID NO: 2892 - protein, 5 aa, Artificial Sequence
  Description of Artificial Sequence: Synthetic peptide
EGLQR

SEQ ID NO: 2893 - protein, 5 aa, Artificial Sequence
  Description of Artificial Sequence: Synthetic peptide
EGLRL

SEQ ID NO: 2894 - protein, 5 aa, Artificial Sequence
  Description of Artificial Sequence: Synthetic peptide
EGLRV

SEQ ID NO: 2895 - protein, 5 aa, Artificial Sequence
  Description of Artificial Sequence: Synthetic peptide
EGVRR

SEQ ID NO: 2896 - protein, 5 aa, Artificial Sequence
  Description of Artificial Sequence: Synthetic peptide
ELLRR

SEQ ID NO: 2897 - protein, 5 aa, Artificial Sequence
  Description of Artificial Sequence: Synthetic peptide
ENLER

SEQ ID NO: 2898 - protein, 5 aa, Artificial Sequence
  Description of Artificial Sequence: Synthetic peptide
ETLLR

SEQ ID NO: 2899 - protein, 5 aa, Artificial Sequence
  Description of Artificial Sequence: Synthetic peptide
GALHR

SEQ ID NO: 2900 - protein, 5 aa, Artificial Sequence
  Description of Artificial Sequence: Synthetic peptide
GGHRR

SEQ ID NO: 2901 - protein, 5 aa, Artificial Sequence
  Description of Artificial Sequence: Synthetic peptide
GGLAG

SEQ ID NO: 2902 - protein, 5 aa, Artificial Sequence
  Description of Artificial Sequence: Synthetic peptide
GGLDV

SEQ ID NO: 2903 - protein, 5 aa, Artificial Sequence
  Description of Artificial Sequence: Synthetic peptide
GGLGS

SEQ ID NO: 2904 - protein, 5 aa, Artificial Sequence
  Description of Artificial Sequence: Synthetic peptide
GGLQE

SEQ ID NO: 2905 - protein, 5 aa, Artificial Sequence
  Description of Artificial Sequence: Synthetic peptide
GGLVL

SEQ ID NO: 2906 - protein, 5 aa, Artificial Sequence
  Description of Artificial Sequence: Synthetic peptide
GGPSH

SEQ ID NO: 2907 - protein, 5 aa, Artificial Sequence
  Description of Artificial Sequence: Synthetic peptide
GGPSR

SEQ ID NO: 2908 - protein, 5 aa, Artificial Sequence
  Description of Artificial Sequence: Synthetic peptide
GGQRR

SEQ ID NO: 2909 - protein, 5 aa, Artificial Sequence
  Description of Artificial Sequence: Synthetic peptide
GGVRR

SEQ ID NO: 2910 - protein, 4 aa, Artificial Sequence
  Description of Artificial Sequence: Synthetic peptide
GGWR

SEQ ID NO: 2911 - protein, 5 aa, Artificial Sequence
  Description of Artificial Sequence: Synthetic peptide
GILER

SEQ ID NO: 2912 - protein, 5 aa, Artificial Sequence
  Description of Artificial Sequence: Synthetic peptide
GKLRR

SEQ ID NO: 2913 - protein, 5 aa, Artificial Sequence
  Description of Artificial Sequence: Synthetic peptide
GMLAR

SEQ ID NO: 2914 - protein, 5 aa, Artificial Sequence
  Description of Artificial Sequence: Synthetic peptide
GNLIR

SEQ ID NO: 2915 - protein, 5 aa, Artificial Sequence
  Description of Artificial Sequence: Synthetic peptide
GSLER

SEQ ID NO: 2916 - protein, 5 aa, Artificial Sequence
  Description of Artificial Sequence: Synthetic peptide
GSLVR

SEQ ID NO: 2917 - protein, 5 aa, Artificial Sequence
  Description of Artificial Sequence: Synthetic peptide
GTLER

SEQ ID NO: 2918 - protein, 5 aa, Artificial Sequence
  Description of Artificial Sequence: Synthetic peptide
GTLGR

SEQ ID NO: 2919 - protein, 5 aa, Artificial Sequence
  Description of Artificial Sequence: Synthetic peptide
GTLHR

SEQ ID NO: 2920 - protein, 5 aa, Artificial Sequence
  Description of Artificial Sequence: Synthetic peptide
GTQVR

SEQ ID NO: 2921 - protein, 5 aa, Artificial Sequence
  Description of Artificial Sequence: Synthetic peptide
GVLRR

SEQ ID NO: 2922 - protein, 5 aa, Artificial Sequence
  Description of Artificial Sequence: Synthetic peptide
GVLTR

SEQ ID NO: 2923 - protein, 5 aa, Artificial Sequence
  Description of Artificial Sequence: Synthetic peptide
HALGR

SEQ ID NO: 2924 - protein, 5 aa, Artificial Sequence
  Description of Artificial Sequence: Synthetic peptide
HDLAK

SEQ ID NO: 2925 - protein, 5 aa, Artificial Sequence
  Description of Artificial Sequence: Synthetic peptide
HGAAR

SEQ ID NO: 2926 - protein, 5 aa, Artificial Sequence
  Description of Artificial Sequence: Synthetic peptide
HGLSV

SEQ ID NO: 2927 - protein, 5 aa, Artificial Sequence
  Description of Artificial Sequence: Synthetic peptide
HGLTW

SEQ ID NO: 2928 - protein, 5 aa, Artificial Sequence
  Description of Artificial Sequence: Synthetic peptide
HGPAR

SEQ ID NO: 2929 - protein, 5 aa, Artificial Sequence
  Description of Artificial Sequence: Synthetic peptide
HKLAR

SEQ ID NO: 2930 - protein, 5 aa, Artificial Sequence
  Description of Artificial Sequence: Synthetic peptide
HNLLS

SEQ ID NO: 2931 - protein, 5 aa, Artificial Sequence
  Description of Artificial Sequence: Synthetic peptide
HRLSR

SEQ ID NO: 2932 - protein, 5 aa, Artificial Sequence
  Description of Artificial Sequence: Synthetic peptide
HSLNR

SEQ ID NO: 2933 - protein, 5 aa, Artificial Sequence
  Description of Artificial Sequence: Synthetic peptide
HSLSR

SEQ ID NO: 2934 - protein, 5 aa, Artificial Sequence
  Description of Artificial Sequence: Synthetic peptide
HTLHR

SEQ ID NO: 2935 - protein, 5 aa, Artificial Sequence
  Description of Artificial Sequence: Synthetic peptide
HVLAR

SEQ ID NO: 2936 - protein, 5 aa, Artificial Sequence
  Description of Artificial Sequence: Synthetic peptide
INLSR

SEQ ID NO: 2937 - protein, 5 aa, Artificial Sequence
  Description of Artificial Sequence: Synthetic peptide
NALAR

SEQ ID NO: 2938 - protein, 5 aa, Artificial Sequence
  Description of Artificial Sequence: Synthetic peptide
NHLVQ

SEQ ID NO: 2939 - protein, 5 aa, Artificial Sequence
  Description of Artificial Sequence: Synthetic peptide
NTLIR

SEQ ID NO: 2940 - protein, 5 aa, Artificial Sequence
  Description of Artificial Sequence: Synthetic peptide
NTLNR

SEQ ID NO: 2941 - protein, 5 aa, Artificial Sequence
  Description of Artificial Sequence: Synthetic peptide
NTLQR

SEQ ID NO: 2942 - protein, 5 aa, Artificial Sequence
  Description of Artificial Sequence: Synthetic peptide
NVLKR

SEQ ID NO: 2943 - protein, 5 aa, Artificial Sequence
  Description of Artificial Sequence: Synthetic peptide
PALKR

SEQ ID NO: 2944 - protein, 5 aa, Artificial Sequence
  Description of Artificial Sequence: Synthetic peptide
PGLLR

SEQ ID NO: 2945 - protein, 5 aa, Artificial Sequence
  Description of Artificial Sequence: Synthetic peptide
QAAWG

SEQ ID NO: 2946 - protein, 5 aa, Artificial Sequence
  Description of Artificial Sequence: Synthetic peptide
QALAR

SEQ ID NO: 2947 - protein, 5 aa, Artificial Sequence
  Description of Artificial Sequence: Synthetic peptide
QALTR

SEQ ID NO: 2948 - protein, 5 aa, Artificial Sequence
  Description of Artificial Sequence: Synthetic peptide
QDLIR

SEQ ID NO: 2949 - protein, 5 aa, Artificial Sequence
  Description of Artificial Sequence: Synthetic peptide
QTLAR

SEQ ID NO: 2950 - protein, 5 aa, Artificial Sequence
  Description of Artificial Sequence: Synthetic peptide
QTLQR

SEQ ID NO: 2951 - protein, 5 aa, Artificial Sequence
  Description of Artificial Sequence: Synthetic peptide
QVLRR

SEQ ID NO: 2952 - protein, 5 aa, Artificial Sequence
  Description of Artificial Sequence: Synthetic peptide
RGLTR

SEQ ID NO: 2953 - protein, 5 aa, Artificial Sequence
  Description of Artificial Sequence: Synthetic peptide
RGLVR

SEQ ID NO: 2954 - protein, 5 aa, Artificial Sequence
  Description of Artificial Sequence: Synthetic peptide
SALDR

SEQ ID NO: 2955 - protein, 5 aa, Artificial Sequence
  Description of Artificial Sequence: Synthetic peptide
SALMC

SEQ ID NO: 2956 - protein, 5 aa, Artificial Sequence
  Description of Artificial Sequence: Synthetic peptide
SALNR

SEQ ID NO: 2957 - protein, 5 aa, Artificial Sequence
  Description of Artificial Sequence: Synthetic peptide
SDLAR

SEQ ID NO: 2958 - protein, 5 aa, Artificial Sequence
  Description of Artificial Sequence: Synthetic peptide
SDLQR

SEQ ID NO: 2959 - protein, 5 aa, Artificial Sequence
  Description of Artificial Sequence: Synthetic peptide
SDLRR

SEQ ID NO: 2960 - protein, 5 aa, Artificial Sequence
  Description of Artificial Sequence: Synthetic peptide
SGPRR

SEQ ID NO: 2961 - protein, 5 aa, Artificial Sequence
  Description of Artificial Sequence: Synthetic peptide
SLLSD

SEQ ID NO: 2962 - protein, 5 aa, Artificial Sequence
  Description of Artificial Sequence: Synthetic peptide
SMLHR

SEQ ID NO: 2963 - protein, 5 aa, Artificial Sequence
  Description of Artificial Sequence: Synthetic peptide
SNLQR

SEQ ID NO: 2964 - protein, 5 aa, Artificial Sequence
  Description of Artificial Sequence: Synthetic peptide
SSLIR

SEQ ID NO: 2965 - protein, 5 aa, Artificial Sequence
  Description of Artificial Sequence: Synthetic peptide
SSLKR

SEQ ID NO: 2966 - protein, 5 aa, Artificial Sequence
  Description of Artificial Sequence: Synthetic peptide
STLLR

SEQ ID NO: 2967 - protein, 5 aa, Artificial Sequence
  Description of Artificial Sequence: Synthetic peptide
STLNR

SEQ ID NO: 2968 - protein, 5 aa, Artificial Sequence
  Description of Artificial Sequence: Synthetic peptide
STLRK

SEQ ID NO: 2969 - protein, 5 aa, Artificial Sequence
  Description of Artificial Sequence: Synthetic peptide
SVLGR

SEQ ID NO: 2970 - protein, 5 aa, Artificial Sequence
  Description of Artificial Sequence: Synthetic peptide
SVLRR

SEQ ID NO: 2971 - protein, 5 aa, Artificial Sequence
  Description of Artificial Sequence: Synthetic peptide
TALER

SEQ ID NO: 2972 - protein, 5 aa, Artificial Sequence
  Description of Artificial Sequence: Synthetic peptide
TALRT

SEQ ID NO: 2973 - protein, 5 aa, Artificial Sequence
  Description of Artificial Sequence: Synthetic peptide
TDLAR

SEQ ID NO: 2974 - protein, 5 aa, Artificial Sequence
  Description of Artificial Sequence: Synthetic peptide
TDLRR

SEQ ID NO: 2975 - protein, 5 aa, Artificial Sequence
  Description of Artificial Sequence: Synthetic peptide
TGLQV

SEQ ID NO: 2976 - protein, 6 aa, Artificial Sequence
  Description of Artificial Sequence: Synthetic peptide
TGLVRR

SEQ ID NO: 2977 - protein, 5 aa, Artificial Sequence
  Description of Artificial Sequence: Synthetic peptide
TGPAR

SEQ ID NO: 2978 - protein, 5 aa, Artificial Sequence
  Description of Artificial Sequence: Synthetic peptide
TMLKR

SEQ ID NO: 2979 - protein, 5 aa, Artificial Sequence
  Description of Artificial Sequence: Synthetic peptide
TNLPR

SEQ ID NO: 2980 - protein, 5 aa, Artificial Sequence
  Description of Artificial Sequence: Synthetic peptide
TSLAR

SEQ ID NO: 2981 - protein, 5 aa, Artificial Sequence
  Description of Artificial Sequence: Synthetic peptide
TSLGG

SEQ ID NO: 2982 - protein, 5 aa, Artificial Sequence
  Description of Artificial Sequence: Synthetic peptide
TSLGR

SEQ ID NO: 2983 - protein, 5 aa, Artificial Sequence
  Description of Artificial Sequence: Synthetic peptide
TSLQR

SEQ ID NO: 2984 - protein, 5 aa, Artificial Sequence
  Description of Artificial Sequence: Synthetic peptide
TSLVR

SEQ ID NO: 2985 - protein, 5 aa, Artificial Sequence
  Description of Artificial Sequence: Synthetic peptide
VALAR

SEQ ID NO: 2986 - protein, 5 aa, Artificial Sequence
  Description of Artificial Sequence: Synthetic peptide
VALKR

SEQ ID NO: 2987 - protein, 5 aa, Artificial Sequence
  Description of Artificial Sequence: Synthetic peptide
VALSR

SEQ ID NO: 2988 - protein, 5 aa, Artificial Sequence
  Description of Artificial Sequence: Synthetic peptide
VGLKC

SEQ ID NO: 2989 - protein, 5 aa, Artificial Sequence
  Description of Artificial Sequence: Synthetic peptide
VGLSR

SEQ ID NO: 2990 - protein, 5 aa, Artificial Sequence
  Description of Artificial Sequence: Synthetic peptide
VGLTM

SEQ ID NO: 2991 - protein, 5 aa, Artificial Sequence
  Description of Artificial Sequence: Synthetic peptide
VNLAR

SEQ ID NO: 2992 - protein, 5 aa, Artificial Sequence
  Description of Artificial Sequence: Synthetic peptide
VNLIR

SEQ ID NO: 2993 - protein, 5 aa, Artificial Sequence
  Description of Artificial Sequence: Synthetic peptide
VNLNR

SEQ ID NO: 2994 - protein, 5 aa, Artificial Sequence
  Description of Artificial Sequence: Synthetic peptide
VTLGR

SEQ ID NO: 2995 - protein, 5 aa, Artificial Sequence
  Description of Artificial Sequence: Synthetic peptide
VTLKR

SEQ ID NO: 2996 - protein, 5 aa, Artificial Sequence
  Description of Artificial Sequence: Synthetic peptide
VTLMR

SEQ ID NO: 2997 - protein, 5 aa, Artificial Sequence
  Description of Artificial Sequence: Synthetic peptide
VTLRR

SEQ ID NO: 2998 - protein, 5 aa, Artificial Sequence
  Description of Artificial Sequence: Synthetic peptide
WGLER

SEQ ID NO: 2999 - protein, 5 aa, Artificial Sequence
  Description of Artificial Sequence: Synthetic peptide
DALTR

SEQ ID NO: 3000 - protein, 5 aa, Artificial Sequence
  Description of Artificial Sequence: Synthetic peptide
DALIR

SEQ ID NO: 3001 - protein, 5 aa, Artificial Sequence
  Description of Artificial Sequence: Synthetic peptide
GVLKR

SEQ ID NO: 3002 - protein, 5 aa, Artificial Sequence
  Description of Artificial Sequence: Synthetic peptide
GDLHR

SEQ ID NO: 3003 - protein, 5 aa, Artificial Sequence
  Description of Artificial Sequence: Synthetic peptide
GDLNR

SEQ ID NO: 3004 - protein, 5 aa, Artificial Sequence
  Description of Artificial Sequence: Synthetic peptide
SILKR

SEQ ID NO: 3005 - protein, 5 aa, Artificial Sequence
  Description of Artificial Sequence: Synthetic peptide
DTLIR

SEQ ID NO: 3006 - protein, 5 aa, Artificial Sequence
  Description of Artificial Sequence: Synthetic peptide
NTLTR

SEQ ID NO: 3007 - protein, 5 aa, Artificial Sequence
  Description of Artificial Sequence: Synthetic peptide
HTLIR

SEQ ID NO: 3008 - protein, 5 aa, Artificial Sequence
  Description of Artificial Sequence: Synthetic peptide
EVLRR

SEQ ID NO: 3009 - protein, 5 aa, Artificial Sequence
  Description of Artificial Sequence: Synthetic peptide
GDLSR

SEQ ID NO: 3010 - protein, 5 aa, Artificial Sequence
  Description of Artificial Sequence: Synthetic peptide
HVLRR

SEQ ID NO: 3011 - protein, 5 aa, Artificial Sequence
  Description of Artificial Sequence: Synthetic peptide
TDLTR

SEQ ID NO: 3012 - protein, 5 aa, Artificial Sequence
  Description of Artificial Sequence: Synthetic peptide
ATLHR

SEQ ID NO: 3013 - protein, 5 aa, Artificial Sequence
  Description of Artificial Sequence: Synthetic peptide
DSLVR

SEQ ID NO: 3014 - protein, 5 aa, Artificial Sequence
  Description of Artificial Sequence: Synthetic peptide
GTLDR

SEQ ID NO: 3015 - protein, 5 aa, Artificial Sequence
  Description of Artificial Sequence: Synthetic peptide
NTLLR

SEQ ID NO: 3016 - protein, 5 aa, Artificial Sequence
  Description of Artificial Sequence: Synthetic peptide
HDLQR

SEQ ID NO: 3017 - protein, 5 aa, Artificial Sequence
  Description of Artificial Sequence: Synthetic peptide
ATLNR

SEQ ID NO: 3018 - protein, 5 aa, Artificial Sequence
  Description of Artificial Sequence: Synthetic peptide
STLIR

SEQ ID NO: 3019 - protein, 5 aa, Artificial Sequence
  Description of Artificial Sequence: Synthetic peptide
TTLSR

SEQ ID NO: 3020 - protein, 5 aa, Artificial Sequence
  Description of Artificial Sequence: Synthetic peptide
DILKR

SEQ ID NO: 3021 - protein, 5 aa, Artificial Sequence
  Description of Artificial Sequence: Synthetic peptide
ETLNR

SEQ ID NO: 3022 - protein, 5 aa, Artificial Sequence
  Description of Artificial Sequence: Synthetic peptide
MDLKR

SEQ ID NO: 3023 - protein, 5 aa, Artificial Sequence
  Description of Artificial Sequence: Synthetic peptide
QDLRR

SEQ ID NO: 3024 - protein, 5 aa, Artificial Sequence
  Description of Artificial Sequence: Synthetic peptide
TSLTR

SEQ ID NO: 3025 - protein, 5 aa, Artificial Sequence
  Description of Artificial Sequence: Synthetic peptide
ATLGR

SEQ ID NO: 3026 - protein, 5 aa, Artificial Sequence
  Description of Artificial Sequence: Synthetic peptide
GDLQR

SEQ ID NO: 3027 - protein, 5 aa, Artificial Sequence
  Description of Artificial Sequence: Synthetic peptide
NTLVR

SEQ ID NO: 3028 - protein, 5 aa, Artificial Sequence
  Description of Artificial Sequence: Synthetic peptide
SILRR

SEQ ID NO: 3029 - protein, 5 aa, Artificial Sequence
  Description of Artificial Sequence: Synthetic peptide
DTLER

SEQ ID NO: 3030 - protein, 5 aa, Artificial Sequence
  Description of Artificial Sequence: Synthetic peptide
DTLLR

SEQ ID NO: 3031 - protein, 5 aa, Artificial Sequence
  Description of Artificial Sequence: Synthetic peptide
SDLTR

SEQ ID NO: 3032 - protein, 5 aa, Artificial Sequence
  Description of Artificial Sequence: Synthetic peptide
SMLKR

SEQ ID NO: 3033 - protein, 5 aa, Artificial Sequence
  Description of Artificial Sequence: Synthetic peptide
GTLLR

SEQ ID NO: 3034 - protein, 5 aa, Artificial Sequence
  Description of Artificial Sequence: Synthetic peptide
DTLGR

SEQ ID NO: 3035 - protein, 5 aa, Artificial Sequence
  Description of Artificial Sequence: Synthetic peptide
GDLAR

SEQ ID NO: 3036 - protein, 5 aa, Artificial Sequence
  Description of Artificial Sequence: Synthetic peptide
HVLVR

SEQ ID NO: 3037 - protein, 5 aa, Artificial Sequence
  Description of Artificial Sequence: Synthetic peptide
QDLAR

SEQ ID NO: 3038 - protein, 5 aa, Artificial Sequence
  Description of Artificial Sequence: Synthetic peptide
ETLAR

SEQ ID NO: 3039 - protein, 5 aa, Artificial Sequence
  Description of Artificial Sequence: Synthetic peptide
HILKR

SEQ ID NO: 3040 - protein, 5 aa, Artificial Sequence
  Description of Artificial Sequence: Synthetic peptide
HMLVR

SEQ ID NO: 3041 - protein, 5 aa, Artificial Sequence
  Description of Artificial Sequence: Synthetic peptide
NTLSR

SEQ ID NO: 3042 - protein, 5 aa, Artificial Sequence
  Description of Artificial Sequence: Synthetic peptide
SDLVR

SEQ ID NO: 3043 - protein, 5 aa, Artificial Sequence
  Description of Artificial Sequence: Synthetic peptide
ETLQR

SEQ ID NO: 3044 - protein, 5 aa, Artificial Sequence
  Description of Artificial Sequence: Synthetic peptide
HDLGR

SEQ ID NO: 3045 - protein, 5 aa, Artificial Sequence
  Description of Artificial Sequence: Synthetic peptide
HDLTR

SEQ ID NO: 3046 - protein, 5 aa, Artificial Sequence
  Description of Artificial Sequence: Synthetic peptide
TDLKR

SEQ ID NO: 3047 - protein, 5 aa, Artificial Sequence
  Description of Artificial Sequence: Synthetic peptide
TSLNR

SEQ ID NO: 3048 - protein, 5 aa, Artificial Sequence
  Description of Artificial Sequence: Synthetic peptide
VDLKR

SEQ ID NO: 3049 - protein, 5 aa, Artificial Sequence
  Description of Artificial Sequence: Synthetic peptide
GILKR

SEQ ID NO: 3050 - protein, 5 aa, Artificial Sequence
  Description of Artificial Sequence: Synthetic peptide
HNLKR

SEQ ID NO: 3051 - protein, 5 aa, Artificial Sequence
  Description of Artificial Sequence: Synthetic peptide
QDLQR

SEQ ID NO: 3052 - protein, 5 aa, Artificial Sequence
  Description of Artificial Sequence: Synthetic peptide
SDLGR

SEQ ID NO: 3053 - protein, 5 aa, Artificial Sequence
  Description of Artificial Sequence: Synthetic peptide
TDLSR

SEQ ID NO: 3054 - protein, 5 aa, Artificial Sequence
  Description of Artificial Sequence: Synthetic peptide
DILVR

SEQ ID NO: 3055 - protein, 5 aa, Artificial Sequence
  Description of Artificial Sequence: Synthetic peptide
GVLVG

SEQ ID NO: 3056 - protein, 5 aa, Artificial Sequence
  Description of Artificial Sequence: Synthetic peptide
HSLTR

SEQ ID NO: 3057 - protein, 5 aa, Artificial Sequence
  Description of Artificial Sequence: Synthetic peptide
HTLDR

SEQ ID NO: 3058 - protein, 5 aa, Artificial Sequence
  Description of Artificial Sequence: Synthetic peptide
QQLQR

SEQ ID NO: 3059 - protein, 5 aa, Artificial Sequence
  Description of Artificial Sequence: Synthetic peptide
SVLLR

SEQ ID NO: 3060 - protein, 5 aa, Artificial Sequence
  Description of Artificial Sequence: Synthetic peptide
TDLGR

SEQ ID NO: 3061 - protein, 5 aa, Artificial Sequence
  Description of Artificial Sequence: Synthetic peptide
TDLQR

SEQ ID NO: 3062 - protein, 5 aa, Artificial Sequence
  Description of Artificial Sequence: Synthetic peptide
ALLKR

SEQ ID NO: 3063 - protein, 5 aa, Artificial Sequence
  Description of Artificial Sequence: Synthetic peptide
DTLRK

SEQ ID NO: 3064 - protein, 5 aa, Artificial Sequence
  Description of Artificial Sequence: Synthetic peptide
ETLTR

SEQ ID NO: 3065 - protein, 5 aa, Artificial Sequence
  Description of Artificial Sequence: Synthetic peptide
GELTR

SEQ ID NO: 3066 - protein, 5 aa, Artificial Sequence
  Description of Artificial Sequence: Synthetic peptide
HDLNR

SEQ ID NO: 3067 - protein, 5 aa, Artificial Sequence
  Description of Artificial Sequence: Synthetic peptide
MTLRR

SEQ ID NO: 3068 - protein, 5 aa, Artificial Sequence
  Description of Artificial Sequence: Synthetic peptide
NTLER

SEQ ID NO: 3069 - protein, 5 aa, Artificial Sequence
  Description of Artificial Sequence: Synthetic peptide
SELKR

SEQ ID NO: 3070 - protein, 5 aa, Artificial Sequence
  Description of Artificial Sequence: Synthetic peptide
STLSM

SEQ ID NO: 3071 - protein, 5 aa, Artificial Sequence
  Description of Artificial Sequence: Synthetic peptide
TDLMR

SEQ ID NO: 3072 - protein, 5 aa, Artificial Sequence
  Description of Artificial Sequence: Synthetic peptide
TSLLR

SEQ ID NO: 3073 - protein, 5 aa, Artificial Sequence
  Description of Artificial Sequence: Synthetic peptide
TSLMR

SEQ ID NO: 3074 - protein, 5 aa, Artificial Sequence
  Description of Artificial Sequence: Synthetic peptide
TTLER

SEQ ID NO: 3075 - protein, 5 aa, Artificial Sequence
  Description of Artificial Sequence: Synthetic peptide
TVLRR

SEQ ID NO: 3076 - protein, 5 aa, Artificial Sequence
  Description of Artificial Sequence: Synthetic peptide
ADLTR

SEQ ID NO: 3077 - protein, 5 aa, Artificial Sequence
  Description of Artificial Sequence: Synthetic peptide
DILTR

SEQ ID NO: 3078 - protein, 5 aa, Artificial Sequence
  Description of Artificial Sequence: Synthetic peptide
DMLQR

SEQ ID NO: 3079 - protein, 5 aa, Artificial Sequence
  Description of Artificial Sequence: Synthetic peptide
DVLVR

SEQ ID NO: 3080 - protein, 5 aa, Artificial Sequence
  Description of Artificial Sequence: Synthetic peptide
ETLRK

SEQ ID NO: 3081 - protein, 5 aa, Artificial Sequence
  Description of Artificial Sequence: Synthetic peptide
GTLMR

SEQ ID NO: 3082 - protein, 4 aa, Artificial Sequence
  Description of Artificial Sequence: Synthetic peptide
HAEG

SEQ ID NO: 3083 - protein, 5 aa, Artificial Sequence
  Description of Artificial Sequence: Synthetic peptide
HDLMR

SEQ ID NO: 3084 - protein, 5 aa, Artificial Sequence
  Description of Artificial Sequence: Synthetic peptide
HMLQR

SEQ ID NO: 3085 - protein, 5 aa, Artificial Sequence
  Description of Artificial Sequence: Synthetic peptide
HSLKR

SEQ ID NO: 3086 - protein, 5 aa, Artificial Sequence
  Description of Artificial Sequence: Synthetic peptide
QSLNR

SEQ ID NO: 3087 - protein, 5 aa, Artificial Sequence
  Description of Artificial Sequence: Synthetic peptide
SILAR

SEQ ID NO: 3088 - protein, 5 aa, Artificial Sequence
  Description of Artificial Sequence: Synthetic peptide
SVLVR

SEQ ID NO: 3089 - protein, 5 aa, Artificial Sequence
  Description of Artificial Sequence: Synthetic peptide
ADLVR

SEQ ID NO: 3090 - protein, 5 aa, Artificial Sequence
  Description of Artificial Sequence: Synthetic peptide
ASLAR

SEQ ID NO: 3091 - protein, 5 aa, Artificial Sequence
  Description of Artificial Sequence: Synthetic peptide
ASLIR

SEQ ID NO: 3092 - protein, 5 aa, Artificial Sequence
  Description of Artificial Sequence: Synthetic peptide
DVLMR

SEQ ID NO: 3093 - protein, 5 aa, Artificial Sequence
  Description of Artificial Sequence: Synthetic peptide
DVLQR

SEQ ID NO: 3094 - protein, 5 aa, Artificial Sequence
  Description of Artificial Sequence: Synthetic peptide
EGLGR

SEQ ID NO: 3095 - protein, 5 aa, Artificial Sequence
  Description of Artificial Sequence: Synthetic peptide
EGLHR

SEQ ID NO: 3096 - protein, 5 aa, Artificial Sequence
  Description of Artificial Sequence: Synthetic peptide
HDLSR

SEQ ID NO: 3097 - protein, 5 aa, Artificial Sequence
  Description of Artificial Sequence: Synthetic peptide
HILMR

SEQ ID NO: 3098 - protein, 5 aa, Artificial Sequence
  Description of Artificial Sequence: Synthetic peptide
HSLQR

SEQ ID NO: 3099 - protein, 5 aa, Artificial Sequence
  Description of Artificial Sequence: Synthetic peptide
HVLHR

SEQ ID NO: 3100 - protein, 5 aa, Artificial Sequence
  Description of Artificial Sequence: Synthetic peptide
IDLKR

SEQ ID NO: 3101 - protein, 5 aa, Artificial Sequence
  Description of Artificial Sequence: Synthetic peptide
NILVR

SEQ ID NO: 3102 - protein, 5 aa, Artificial Sequence
  Description of Artificial Sequence: Synthetic peptide
PGLAR

SEQ ID NO: 3103 - protein, 5 aa, Artificial Sequence
  Description of Artificial Sequence: Synthetic peptide
PTLMR

SEQ ID NO: 3104 - protein, 5 aa, Artificial Sequence
  Description of Artificial Sequence: Synthetic peptide
QTLSR

SEQ ID NO: 3105 - protein, 5 aa, Artificial Sequence
  Description of Artificial Sequence: Synthetic peptide
SELRR

SEQ ID NO: 3106 - protein, 5 aa, Artificial Sequence
  Description of Artificial Sequence: Synthetic peptide
TDLHR

SEQ ID NO: 3107 - protein, 5 aa, Artificial Sequence
  Description of Artificial Sequence: Synthetic peptide
TDLVR

SEQ ID NO: 3108 - protein, 5 aa, Artificial Sequence
  Description of Artificial Sequence: Synthetic peptide
TGLKL

SEQ ID NO: 3109 - protein, 5 aa, Artificial Sequence
  Description of Artificial Sequence: Synthetic peptide
TMLNR

SEQ ID NO: 3110 - protein, 5 aa, Artificial Sequence
  Description of Artificial Sequence: Synthetic peptide
TSLIR

SEQ ID NO: 3111 - protein, 5 aa, Artificial Sequence
  Description of Artificial Sequence: Synthetic peptide
VDLRR

SEQ ID NO: 3112 - protein, 5 aa, Artificial Sequence
  Description of Artificial Sequence: Synthetic peptide
VTLAR

SEQ ID NO: 3113 - protein, 5 aa, Artificial Sequence
  Description of Artificial Sequence: Synthetic peptide
AALHR

SEQ ID NO: 3114 - protein, 5 aa, Artificial Sequence
  Description of Artificial Sequence: Synthetic peptide
ADLNR

SEQ ID NO: 3115 - protein, 5 aa, Artificial Sequence
  Description of Artificial Sequence: Synthetic peptide
ADLRV

SEQ ID NO: 3116 - protein, 5 aa, Artificial Sequence
  Description of Artificial Sequence: Synthetic peptide
AGLKK

SEQ ID NO: 3117 - protein, 5 aa, Artificial Sequence
  Description of Artificial Sequence: Synthetic peptide
AILRR

SEQ ID NO: 3118 - protein, 5 aa, Artificial Sequence
  Description of Artificial Sequence: Synthetic peptide
ASLKS

SEQ ID NO: 3119 - protein, 5 aa, Artificial Sequence
  Description of Artificial Sequence: Synthetic peptide
ASMKR

SEQ ID NO: 3120 - protein, 5 aa, Artificial Sequence
  Description of Artificial Sequence: Synthetic peptide
ATPVP

SEQ ID NO: 3121 - protein, 5 aa, Artificial Sequence
  Description of Artificial Sequence: Synthetic peptide
AVLTR

SEQ ID NO: 3122 - protein, 5 aa, Artificial Sequence
  Description of Artificial Sequence: Synthetic peptide
CGLRR

SEQ ID NO: 3123 - protein, 4 aa, Artificial Sequence
  Description of Artificial Sequence: Synthetic peptide
DAEA

SEQ ID NO: 3124 - protein, 5 aa, Artificial Sequence
  Description of Artificial Sequence: Synthetic peptide
DALER

SEQ ID NO: 3125 - protein, 5 aa, Artificial Sequence
  Description of Artificial Sequence: Synthetic peptide
DALPR

SEQ ID NO: 3126 - protein, 5 aa, Artificial Sequence
  Description of Artificial Sequence: Synthetic peptide
DARRR

SEQ ID NO: 3127 - protein, 5 aa, Artificial Sequence
  Description of Artificial Sequence: Synthetic peptide
DDLNR

SEQ ID NO: 3128 - protein, 5 aa, Artificial Sequence
  Description of Artificial Sequence: Synthetic peptide
DGAAE

SEQ ID NO: 3129 - protein, 5 aa, Artificial Sequence
  Description of Artificial Sequence: Synthetic peptide
DGLWR

SEQ ID NO: 3130 - protein, 5 aa, Artificial Sequence
  Description of Artificial Sequence: Synthetic peptide
DGPAR

SEQ ID NO: 3131 - protein, 5 aa, Artificial Sequence
  Description of Artificial Sequence: Synthetic peptide
DGPKK

SEQ ID NO: 3132 - protein, 5 aa, Artificial Sequence
  Description of Artificial Sequence: Synthetic peptide
DGRRR

SEQ ID NO: 3133 - protein, 5 aa, Artificial Sequence
  Description of Artificial Sequence: Synthetic peptide
DGVRR

SEQ ID NO: 3134 - protein, 5 aa, Artificial Sequence
  Description of Artificial Sequence: Synthetic peptide
DMLTR

SEQ ID NO: 3135 - protein, 5 aa, Artificial Sequence
  Description of Artificial Sequence: Synthetic peptide
DSLNR

SEQ ID NO: 3136 - protein, 5 aa, Artificial Sequence
  Description of Artificial Sequence: Synthetic peptide
DTLDR

SEQ ID NO: 3137 - protein, 5 aa, Artificial Sequence
  Description of Artificial Sequence: Synthetic peptide
DVLRK

SEQ ID NO: 3138 - protein, 5 aa, Artificial Sequence
  Description of Artificial Sequence: Synthetic peptide
DVLRS

SEQ ID NO: 3139 - protein, 5 aa, Artificial Sequence
  Description of Artificial Sequence: Synthetic peptide
DVLSR

SEQ ID NO: 3140 - protein, 5 aa, Artificial Sequence
  Description of Artificial Sequence: Synthetic peptide
DVQKR

SEQ ID NO: 3141 - protein, 5 aa, Artificial Sequence
  Description of Artificial Sequence: Synthetic peptide
EALVR

SEQ ID NO: 3142 - protein, 5 aa, Artificial Sequence
  Description of Artificial Sequence: Synthetic peptide
EGLKM

SEQ ID NO: 3143 - protein, 5 aa, Artificial Sequence
  Description of Artificial Sequence: Synthetic peptide
EGLQC

SEQ ID NO: 3144 - protein, 5 aa, Artificial Sequence
  Description of Artificial Sequence: Synthetic peptide
EGLRS

SEQ ID NO: 3145 - protein, 5 aa, Artificial Sequence
  Description of Artificial Sequence: Synthetic peptide
EGRRR

SEQ ID NO: 3146 - protein, 4 aa, Artificial Sequence
  Description of Artificial Sequence: Synthetic peptide
EGWS

SEQ ID NO: 3147 - protein, 5 aa, Artificial Sequence
  Description of Artificial Sequence: Synthetic peptide
ESLAR

SEQ ID NO: 3148 - protein, 5 aa, Artificial Sequence
  Description of Artificial Sequence: Synthetic peptide
ETGWG

SEQ ID NO: 3149 - protein, 5 aa, Artificial Sequence
  Description of Artificial Sequence: Synthetic peptide
ETLER

SEQ ID NO: 3150 - protein, 5 aa, Artificial Sequence
  Description of Artificial Sequence: Synthetic peptide
ETLHR

SEQ ID NO: 3151 - protein, 5 aa, Artificial Sequence
  Description of Artificial Sequence: Synthetic peptide
ETLVR

SEQ ID NO: 3152 - protein, 5 aa, Artificial Sequence
  Description of Artificial Sequence: Synthetic peptide
ETRRR

SEQ ID NO: 3153 - protein, 5 aa, Artificial Sequence
  Description of Artificial Sequence: Synthetic peptide
EVLKR

SEQ ID NO: 3154 - protein, 5 aa, Artificial Sequence
  Description of Artificial Sequence: Synthetic peptide
GALAR

SEQ ID NO: 3155 - protein, 5 aa, Artificial Sequence
  Description of Artificial Sequence: Synthetic peptide
GDLYR

SEQ ID NO: 3156 - protein, 5 aa, Artificial Sequence
  Description of Artificial Sequence: Synthetic peptide
GDPAP

SEQ ID NO: 3157 - protein, 5 aa, Artificial Sequence
  Description of Artificial Sequence: Synthetic peptide
GGQTR

SEQ ID NO: 3158 - protein, 5 aa, Artificial Sequence
  Description of Artificial Sequence: Synthetic peptide
GGVVR

SEQ ID NO: 3159 - protein, 5 aa, Artificial Sequence
  Description of Artificial Sequence: Synthetic peptide
GHLQR

SEQ ID NO: 3160 - protein, 5 aa, Artificial Sequence
  Description of Artificial Sequence: Synthetic peptide
GILRR

SEQ ID NO: 3161 - protein, 5 aa, Artificial Sequence
  Description of Artificial Sequence: Synthetic peptide
GMLRR

SEQ ID NO: 3162 - protein, 5 aa, Artificial Sequence
  Description of Artificial Sequence: Synthetic peptide
GNLLL

SEQ ID NO: 3163 - protein, 5 aa, Artificial Sequence
  Description of Artificial Sequence: Synthetic peptide
GNLVM

SEQ ID NO: 3164 - protein, 5 aa, Artificial Sequence
  Description of Artificial Sequence: Synthetic peptide
GTLRW

SEQ ID NO: 3165 - protein, 5 aa, Artificial Sequence
  Description of Artificial Sequence: Synthetic peptide
GTPHR

SEQ ID NO: 3166 - protein, 5 aa, Artificial Sequence
  Description of Artificial Sequence: Synthetic peptide
GVLAR

SEQ ID NO: 3167 - protein, 5 aa, Artificial Sequence
  Description of Artificial Sequence: Synthetic peptide
GVLNR

SEQ ID NO: 3168 - protein, 5 aa, Artificial Sequence
  Description of Artificial Sequence: Synthetic peptide
GVLVR

SEQ ID NO: 3169 - protein, 5 aa, Artificial Sequence
  Description of Artificial Sequence: Synthetic peptide
GWLSR

SEQ ID NO: 3170 - protein, 4 aa, Artificial Sequence
  Description of Artificial Sequence: Synthetic peptide
HAEA

SEQ ID NO: 3171 - protein, 5 aa, Artificial Sequence
  Description of Artificial Sequence: Synthetic peptide
HDLKR

SEQ ID NO: 3172 - protein, 5 aa, Artificial Sequence
  Description of Artificial Sequence: Synthetic peptide
HELTR

SEQ ID NO: 3173 - protein, 5 aa, Artificial Sequence
  Description of Artificial Sequence: Synthetic peptide
HGLRW

SEQ ID NO: 3174 - protein, 5 aa, Artificial Sequence
  Description of Artificial Sequence: Synthetic peptide
HGMRR

SEQ ID NO: 3175 - protein, 5 aa, Artificial Sequence
  Description of Artificial Sequence: Synthetic peptide
HILIR

SEQ ID NO: 3176 - protein, 5 aa, Artificial Sequence
  Description of Artificial Sequence: Synthetic peptide
HLLNR

SEQ ID NO: 3177 - protein, 4 aa, Artificial Sequence
  Description of Artificial Sequence: Synthetic peptide
HPAP

SEQ ID NO: 3178 - protein, 5 aa, Artificial Sequence
  Description of Artificial Sequence: Synthetic peptide
HTLNK

SEQ ID NO: 3179 - protein, 5 aa, Artificial Sequence
  Description of Artificial Sequence: Synthetic peptide
HTLRA

SEQ ID NO: 3180 - protein, 5 aa, Artificial Sequence
  Description of Artificial Sequence: Synthetic peptide
HTLRG

SEQ ID NO: 3181 - protein, 5 aa, Artificial Sequence
  Description of Artificial Sequence: Synthetic peptide
HTLSR

SEQ ID NO: 3182 - protein, 5 aa, Artificial Sequence
  Description of Artificial Sequence: Synthetic peptide
HWLLR

SEQ ID NO: 3183 - protein, 5 aa, Artificial Sequence
  Description of Artificial Sequence: Synthetic peptide
ITLTR

SEQ ID NO: 3184 - protein, 5 aa, Artificial Sequence
  Description of Artificial Sequence: Synthetic peptide
KGLPG

SEQ ID NO: 3185 - protein, 5 aa, Artificial Sequence
  Description of Artificial Sequence: Synthetic peptide
MDVKG

SEQ ID NO: 3186 - protein, 5 aa, Artificial Sequence
  Description of Artificial Sequence: Synthetic peptide
MTLIR

SEQ ID NO: 3187 - protein, 4 aa, Artificial Sequence
  Description of Artificial Sequence: Synthetic peptide
PMGS

SEQ ID NO: 3188 - protein, 5 aa, Artificial Sequence
  Description of Artificial Sequence: Synthetic peptide
PALKP

SEQ ID NO: 3189 - protein, 5 aa, Artificial Sequence
  Description of Artificial Sequence: Synthetic peptide
PGWAG

SEQ ID NO: 3190 - protein, 5 aa, Artificial Sequence
  Description of Artificial Sequence: Synthetic peptide
PTLKR

SEQ ID NO: 3191 - protein, 5 aa, Artificial Sequence
  Description of Artificial Sequence: Synthetic peptide
PTLRR

SEQ ID NO: 3192 - protein, 5 aa, Artificial Sequence
  Description of Artificial Sequence: Synthetic peptide
QDLAT

SEQ ID NO: 3193 - protein, 5 aa, Artificial Sequence
  Description of Artificial Sequence: Synthetic peptide
QDLVR

SEQ ID NO: 3194 - protein, 5 aa, Artificial Sequence
  Description of Artificial Sequence: Synthetic peptide
QPACV

SEQ ID NO: 3195 - protein, 5 aa, Artificial Sequence
  Description of Artificial Sequence: Synthetic peptide
QTLHR

SEQ ID NO: 3196 - protein, 5 aa, Artificial Sequence
  Description of Artificial Sequence: Synthetic peptide
QTLTR

SEQ ID NO: 3197 - protein, 5 aa, Artificial Sequence
  Description of Artificial Sequence: Synthetic peptide
RGLKR

SEQ ID NO: 3198 - protein, 4 aa, Artificial Sequence
  Description of Artificial Sequence: Synthetic peptide
RPAA

SEQ ID NO: 3199 - protein, 5 aa, Artificial Sequence
  Description of Artificial Sequence: Synthetic peptide
SALHR

SEQ ID NO: 3200 - protein, 5 aa, Artificial Sequence
  Description of Artificial Sequence: Synthetic peptide
SDLKS

SEQ ID NO: 3201 - protein, 5 aa, Artificial Sequence
  Description of Artificial Sequence: Synthetic peptide
SILKV

SEQ ID NO: 3202 - protein, 5 aa, Artificial Sequence
  Description of Artificial Sequence: Synthetic peptide
SILNR

SEQ ID NO: 3203 - protein, 5 aa, Artificial Sequence
  Description of Artificial Sequence: Synthetic peptide
SMLLR

SEQ ID NO: 3204 - protein, 4 aa, Artificial Sequence
  Description of Artificial Sequence: Synthetic peptide
SMLR

SEQ ID NO: 3205 - protein, 5 aa, Artificial Sequence
  Description of Artificial Sequence: Synthetic peptide
SNLHR

SEQ ID NO: 3206 - protein, 5 aa, Artificial Sequence
  Description of Artificial Sequence: Synthetic peptide
SPLHR

SEQ ID NO: 3207 - protein, 5 aa, Artificial Sequence
  Description of Artificial Sequence: Synthetic peptide
SSLKW

SEQ ID NO: 3208 - protein, 5 aa, Artificial Sequence
  Description of Artificial Sequence: Synthetic peptide
STPER

SEQ ID NO: 3209 - protein, 5 aa, Artificial Sequence
  Description of Artificial Sequence: Synthetic peptide
STQVR

SEQ ID NO: 3210 - protein, 5 aa, Artificial Sequence
  Description of Artificial Sequence: Synthetic peptide
SVLQR

SEQ ID NO: 3211 - protein, 5 aa, Artificial Sequence
  Description of Artificial Sequence: Synthetic peptide
SVLSR

SEQ ID NO: 3212 - protein, 5 aa, Artificial Sequence
  Description of Artificial Sequence: Synthetic peptide
TGLKW

SEQ ID NO: 3213 - protein, 5 aa, Artificial Sequence
  Description of Artificial Sequence: Synthetic peptide
TGLNV

SEQ ID NO: 3214 - protein, 5 aa, Artificial Sequence
  Description of Artificial Sequence: Synthetic peptide
TGLQC

SEQ ID NO: 3215 - protein, 5 aa, Artificial Sequence
  Description of Artificial Sequence: Synthetic peptide
TGLRQ

SEQ ID NO: 3216 - protein, 5 aa, Artificial Sequence
  Description of Artificial Sequence: Synthetic peptide
TGPNR

SEQ ID NO: 3217 - protein, 5 aa, Artificial Sequence
  Description of Artificial Sequence: Synthetic peptide
TGQRR

SEQ ID NO: 3218 - protein, 5 aa, Artificial Sequence
  Description of Artificial Sequence: Synthetic peptide
TRLVR

SEQ ID NO: 3219 - protein, 5 aa, Artificial Sequence
  Description of Artificial Sequence: Synthetic peptide
TSLIS

SEQ ID NO: 3220 - protein, 5 aa, Artificial Sequence
  Description of Artificial Sequence: Synthetic peptide
TTLDR

SEQ ID NO: 3221 - protein, 5 aa, Artificial Sequence
  Description of Artificial Sequence: Synthetic peptide
TTLKK

SEQ ID NO: 3222 - protein, 5 aa, Artificial Sequence
  Description of Artificial Sequence: Synthetic peptide
TTLRT

SEQ ID NO: 3223 - protein, 5 aa, Artificial Sequence
  Description of Artificial Sequence: Synthetic peptide
VALRR

SEQ ID NO: 3224 - protein, 5 aa, Artificial Sequence
  Description of Artificial Sequence: Synthetic peptide
VGLHR

SEQ ID NO: 3225 - protein, 5 aa, Artificial Sequence
  Description of Artificial Sequence: Synthetic peptide
VGLNR

SEQ ID NO: 3226 - protein, 5 aa, Artificial Sequence
  Description of Artificial Sequence: Synthetic peptide
YGLAR

SEQ ID NO: 3227 - protein, 5 aa, Artificial Sequence
  Description of Artificial Sequence: Synthetic peptide
YGLVR

SEQ ID NO: 3228 - protein, 5 aa, Artificial Sequence
  Description of Artificial Sequence: Synthetic peptide
YILRR

SEQ ID NO: 3229 - protein, 5 aa, Artificial Sequence
  Description of Artificial Sequence: Synthetic peptide
QALVR

SEQ ID NO: 3230 - protein, 5 aa, Artificial Sequence
  Description of Artificial Sequence: Synthetic peptide
HALTR

SEQ ID NO: 3231 - protein, 5 aa, Artificial Sequence
  Description of Artificial Sequence: Synthetic peptide
SALLR

SEQ ID NO: 3232 - protein, 5 aa, Artificial Sequence
  Description of Artificial Sequence: Synthetic peptide
SSLHR

SEQ ID NO: 3233 - protein, 5 aa, Artificial Sequence
  Description of Artificial Sequence: Synthetic peptide
AALIR

SEQ ID NO: 3234 - protein, 5 aa, Artificial Sequence
  Description of Artificial Sequence: Synthetic peptide
GSLHR

SEQ ID NO: 3235 - protein, 5 aa, Artificial Sequence
  Description of Artificial Sequence: Synthetic peptide
NALQR

SEQ ID NO: 3236 - protein, 5 aa, Artificial Sequence
  Description of Artificial Sequence: Synthetic peptide
NSLVR

SEQ ID NO: 3237 - protein, 5 aa, Artificial Sequence
  Description of Artificial Sequence: Synthetic peptide
AALER

SEQ ID NO: 3238 - protein, 5 aa, Artificial Sequence
  Description of Artificial Sequence: Synthetic peptide
AALGR

SEQ ID NO: 3239 - protein, 5 aa, Artificial Sequence
  Description of Artificial Sequence: Synthetic peptide
GSLIR

SEQ ID NO: 3240 - protein, 5 aa, Artificial Sequence
  Description of Artificial Sequence: Synthetic peptide
GSLNR

SEQ ID NO: 3241 - protein, 5 aa, Artificial Sequence
  Description of Artificial Sequence: Synthetic peptide
QVLKR

SEQ ID NO: 3242 - protein, 5 aa, Artificial Sequence
  Description of Artificial Sequence: Synthetic peptide
TALQR

SEQ ID NO: 3243 - protein, 5 aa, Artificial Sequence
  Description of Artificial Sequence: Synthetic peptide
AALDR

SEQ ID NO: 3244 - protein, 5 aa, Artificial Sequence
  Description of Artificial Sequence: Synthetic peptide
ASLSR

SEQ ID NO: 3245 - protein, 5 aa, Artificial Sequence
  Description of Artificial Sequence: Synthetic peptide
GSLSR

SEQ ID NO: 3246 - protein, 5 aa, Artificial Sequence
  Description of Artificial Sequence: Synthetic peptide
HALQR

SEQ ID NO: 3247 - protein, 5 aa, Artificial Sequence
  Description of Artificial Sequence: Synthetic peptide
NSLSR

SEQ ID NO: 3248 - protein, 5 aa, Artificial Sequence
  Description of Artificial Sequence: Synthetic peptide
QTLVR

SEQ ID NO: 3249 - protein, 5 aa, Artificial Sequence
  Description of Artificial Sequence: Synthetic peptide
TSLER

SEQ ID NO: 3250 - protein, 5 aa, Artificial Sequence
  Description of Artificial Sequence: Synthetic peptide
ASLMR

SEQ ID NO: 3251 - protein, 5 aa, Artificial Sequence
  Description of Artificial Sequence: Synthetic peptide
ASLNR

SEQ ID NO: 3252 - protein, 5 aa, Artificial Sequence
  Description of Artificial Sequence: Synthetic peptide
GALDR

SEQ ID NO: 3253 - protein, 5 aa, Artificial Sequence
  Description of Artificial Sequence: Synthetic peptide
GGPRR

SEQ ID NO: 3254 - protein, 5 aa, Artificial Sequence
  Description of Artificial Sequence: Synthetic peptide
HALNR

SEQ ID NO: 3255 - protein, 5 aa, Artificial Sequence
  Description of Artificial Sequence: Synthetic peptide
MPLTR

SEQ ID NO: 3256 - protein, 5 aa, Artificial Sequence
  Description of Artificial Sequence: Synthetic peptide
AALTG

SEQ ID NO: 3257 - protein, 5 aa, Artificial Sequence
  Description of Artificial Sequence: Synthetic peptide
AGVIR

SEQ ID NO: 3258 - protein, 5 aa, Artificial Sequence
  Description of Artificial Sequence: Synthetic peptide
AGVTR

SEQ ID NO: 3259 - protein, 5 aa, Artificial Sequence
  Description of Artificial Sequence: Synthetic peptide
ASLRG

SEQ ID NO: 3260 - protein, 5 aa, Artificial Sequence
  Description of Artificial Sequence: Synthetic peptide
ATLRM

SEQ ID NO: 3261 - protein, 5 aa, Artificial Sequence
  Description of Artificial Sequence: Synthetic peptide
ATPRR

SEQ ID NO: 3262 - protein, 5 aa, Artificial Sequence
  Description of Artificial Sequence: Synthetic peptide
AVLAR

SEQ ID NO: 3263 - protein, 5 aa, Artificial Sequence
  Description of Artificial Sequence: Synthetic peptide
AVLVR

SEQ ID NO: 3264 - protein, 5 aa, Artificial Sequence
  Description of Artificial Sequence: Synthetic peptide
DGPAA

SEQ ID NO: 3265 - protein, 5 aa, Artificial Sequence
  Description of Artificial Sequence: Synthetic peptide
EALHR

SEQ ID NO: 3266 - protein, 5 aa, Artificial Sequence
  Description of Artificial Sequence: Synthetic peptide
EALSR

SEQ ID NO: 3267 - protein, 5 aa, Artificial Sequence
  Description of Artificial Sequence: Synthetic peptide
EGLRG

SEQ ID NO: 3268 - protein, 5 aa, Artificial Sequence
  Description of Artificial Sequence: Synthetic peptide
GALER

SEQ ID NO: 3269 - protein, 5 aa, Artificial Sequence
  Description of Artificial Sequence: Synthetic peptide
GALGK

SEQ ID NO: 3270 - protein, 5 aa, Artificial Sequence
  Description of Artificial Sequence: Synthetic peptide
GALIR

SEQ ID NO: 3271 - protein, 5 aa, Artificial Sequence
  Description of Artificial Sequence: Synthetic peptide
GALKV

SEQ ID NO: 3272 - protein, 5 aa, Artificial Sequence
  Description of Artificial Sequence: Synthetic peptide
GALMR

SEQ ID NO: 3273 - protein, 5 aa, Artificial Sequence
  Description of Artificial Sequence: Synthetic peptide
GAPRR

SEQ ID NO: 3274 - protein, 5 aa, Artificial Sequence
  Description of Artificial Sequence: Synthetic peptide
GGPAR

SEQ ID NO: 3275 - protein, 5 aa, Artificial Sequence
  Description of Artificial Sequence: Synthetic peptide
GGPVR

SEQ ID NO: 3276 - protein, 5 aa, Artificial Sequence
  Description of Artificial Sequence: Synthetic peptide
GGQVR

SEQ ID NO: 3277 - protein, 5 aa, Artificial Sequence
  Description of Artificial Sequence: Synthetic peptide
GGVAR

SEQ ID NO: 3278 - protein, 4 aa, Artificial Sequence
  Description of Artificial Sequence: Synthetic peptide
GGWP

SEQ ID NO: 3279 - protein, 5 aa, Artificial Sequence
  Description of Artificial Sequence: Synthetic peptide
GSLRV

SEQ ID NO: 3280 - protein, 4 aa, Artificial Sequence
  Description of Artificial Sequence: Synthetic peptide
HAAQ

SEQ ID NO: 3281 - protein, 5 aa, Artificial Sequence
  Description of Artificial Sequence: Synthetic peptide
HALAS

SEQ ID NO: 3282 - protein, 5 aa, Artificial Sequence
  Description of Artificial Sequence: Synthetic peptide
HALER

SEQ ID NO: 3283 - protein, 5 aa, Artificial Sequence
  Description of Artificial Sequence: Synthetic peptide
HALVH

SEQ ID NO: 3284 - protein, 5 aa, Artificial Sequence
  Description of Artificial Sequence: Synthetic peptide
HAMRR

SEQ ID NO: 3285 - protein, 5 aa, Artificial Sequence
  Description of Artificial Sequence: Synthetic peptide
HAQHR

SEQ ID NO: 3286 - protein, 5 aa, Artificial Sequence
  Description of Artificial Sequence: Synthetic peptide
HGLTL

SEQ ID NO: 3287 - protein, 5 aa, Artificial Sequence
  Description of Artificial Sequence: Synthetic peptide
HGLVM

SEQ ID NO: 3288 - protein, 5 aa, Artificial Sequence
  Description of Artificial Sequence: Synthetic peptide
HSLGR

SEQ ID NO: 3289 - protein, 5 aa, Artificial Sequence
  Description of Artificial Sequence: Synthetic peptide
MPLQR

SEQ ID NO: 3290 - protein, 5 aa, Artificial Sequence
  Description of Artificial Sequence: Synthetic peptide
QAPWP

SEQ ID NO: 3291 - protein, 5 aa, Artificial Sequence
  Description of Artificial Sequence: Synthetic peptide
RGLQR

SEQ ID NO: 3292 - protein, 5 aa, Artificial Sequence
  Description of Artificial Sequence: Synthetic peptide
SALQR

SEQ ID NO: 3293 - protein, 4 aa, Artificial Sequence
  Description of Artificial Sequence: Synthetic peptide
SAQR

SEQ ID NO: 3294 - protein, 5 aa, Artificial Sequence
  Description of Artificial Sequence: Synthetic peptide
SARVR

SEQ ID NO: 3295 - protein, 5 aa, Artificial Sequence
  Description of Artificial Sequence: Synthetic peptide
SDLNR

SEQ ID NO: 3296 - protein, 5 aa, Artificial Sequence
  Description of Artificial Sequence: Synthetic peptide
SGADA

SEQ ID NO: 3297 - protein, 4 aa, Artificial Sequence
  Description of Artificial Sequence: Synthetic peptide
SGLR

SEQ ID NO: 3298 - protein, 5 aa, Artificial Sequence
  Description of Artificial Sequence: Synthetic peptide
SGLVC

SEQ ID NO: 3299 - protein, 5 aa, Artificial Sequence
  Description of Artificial Sequence: Synthetic peptide
SGPDP

SEQ ID NO: 3300 - protein, 5 aa, Artificial Sequence
  Description of Artificial Sequence: Synthetic peptide
SSLPR

SEQ ID NO: 3301 - protein, 5 aa, Artificial Sequence
  Description of Artificial Sequence: Synthetic peptide
STPSR

SEQ ID NO: 3302 - protein, 5 aa, Artificial Sequence
  Description of Artificial Sequence: Synthetic peptide
TALLR

SEQ ID NO: 3303 - protein, 5 aa, Artificial Sequence
  Description of Artificial Sequence: Synthetic peptide
TAPTR

SEQ ID NO: 3304 - protein, 5 aa, Artificial Sequence
  Description of Artificial Sequence: Synthetic peptide
TGLIK

SEQ ID NO: 3305 - protein, 5 aa, Artificial Sequence
  Description of Artificial Sequence: Synthetic peptide
TWLRR

SEQ ID NO: 3306 - protein, 5 aa, Artificial Sequence
  Description of Artificial Sequence: Synthetic peptide
VALQR

SEQ ID NO: 3307 - protein, 5 aa, Artificial Sequence
  Description of Artificial Sequence: Synthetic peptide
VSLKR

SEQ ID NO: 3308 - protein, 5 aa, Artificial Sequence
  Description of Artificial Sequence: Synthetic peptide
VSLRR

SEQ ID NO: 3309 - protein, 5 aa, Artificial Sequence
  Description of Artificial Sequence: Synthetic peptide
THLRA

SEQ ID NO: 3310 - protein, 5 aa, Artificial Sequence
  Description of Artificial Sequence: Synthetic peptide
HHLTK

SEQ ID NO: 3311 - protein, 5 aa, Artificial Sequence
  Description of Artificial Sequence: Synthetic peptide
AKLRL

SEQ ID NO: 3312 - protein, 5 aa, Artificial Sequence
  Description of Artificial Sequence: Synthetic peptide
AKLKI

SEQ ID NO: 3313 - protein, 5 aa, Artificial Sequence
  Description of Artificial Sequence: Synthetic peptide
SHLRK

SEQ ID NO: 3314 - protein, 5 aa, Artificial Sequence
  Description of Artificial Sequence: Synthetic peptide
QHLRK

SEQ ID NO: 3315 - protein, 5 aa, Artificial Sequence
  Description of Artificial Sequence: Synthetic peptide
AKLKL

SEQ ID NO: 3316 - protein, 5 aa, Artificial Sequence
  Description of Artificial Sequence: Synthetic peptide
GHLVK

SEQ ID NO: 3317 - protein, 5 aa, Artificial Sequence
  Description of Artificial Sequence: Synthetic peptide
GKLKI

SEQ ID NO: 3318 - protein, 5 aa, Artificial Sequence
  Description of Artificial Sequence: Synthetic peptide
THLRK

SEQ ID NO: 3319 - protein, 5 aa, Artificial Sequence
  Description of Artificial Sequence: Synthetic peptide
AKLKV

SEQ ID NO: 3320 - protein, 5 aa, Artificial Sequence
  Description of Artificial Sequence: Synthetic peptide
GKLRL

SEQ ID NO: 3321 - protein, 5 aa, Artificial Sequence
  Description of Artificial Sequence: Synthetic peptide
GHLRL

SEQ ID NO: 3322 - protein, 5 aa, Artificial Sequence
  Description of Artificial Sequence: Synthetic peptide
TKLKI

SEQ ID NO: 3323 - protein, 5 aa, Artificial Sequence
  Description of Artificial Sequence: Synthetic peptide
RSLGL

SEQ ID NO: 3324 - protein, 5 aa, Artificial Sequence
  Description of Artificial Sequence: Synthetic peptide
AHLRL

SEQ ID NO: 3325 - protein, 5 aa, Artificial Sequence
  Description of Artificial Sequence: Synthetic peptide
TKLRV

SEQ ID NO: 3326 - protein, 5 aa, Artificial Sequence
  Description of Artificial Sequence: Synthetic peptide
SKLKI

SEQ ID NO: 3327 - protein, 5 aa, Artificial Sequence
  Description of Artificial Sequence: Synthetic peptide
SHLVG

SEQ ID NO: 3328 - protein, 5 aa, Artificial Sequence
  Description of Artificial Sequence: Synthetic peptide
GKLKL

SEQ ID NO: 3329 - protein, 5 aa, Artificial Sequence
  Description of Artificial Sequence: Synthetic peptide
THLRT

SEQ ID NO: 3330 - protein, 5 aa, Artificial Sequence
  Description of Artificial Sequence: Synthetic peptide
GHLRR

SEQ ID NO: 3331 - protein, 5 aa, Artificial Sequence
  Description of Artificial Sequence: Synthetic peptide
SHLRL

SEQ ID NO: 3332 - protein, 4 aa, Artificial Sequence
  Description of Artificial Sequence: Synthetic peptide
GALV

SEQ ID NO: 3333 - protein, 5 aa, Artificial Sequence
  Description of Artificial Sequence: Synthetic peptide
GHLKM

SEQ ID NO: 3334 - protein, 5 aa, Artificial Sequence
  Description of Artificial Sequence: Synthetic peptide
SKLRI

SEQ ID NO: 3335 - protein, 4 aa, Artificial Sequence
  Description of Artificial Sequence: Synthetic peptide
GILS

SEQ ID NO: 3336 - protein, 4 aa, Artificial Sequence
  Description of Artificial Sequence: Synthetic peptide
SKVL

SEQ ID NO: 3337 - protein, 5 aa, Artificial Sequence
  Description of Artificial Sequence: Synthetic peptide
SKLVL

SEQ ID NO: 3338 - protein, 5 aa, Artificial Sequence
  Description of Artificial Sequence: Synthetic peptide
IRLGV

SEQ ID NO: 3339 - protein, 5 aa, Artificial Sequence
  Description of Artificial Sequence: Synthetic peptide
MALGL

SEQ ID NO: 3340 - protein, 5 aa, Artificial Sequence
  Description of Artificial Sequence: Synthetic peptide
EHLRK

SEQ ID NO: 3341 - protein, 5 aa, Artificial Sequence
  Description of Artificial Sequence: Synthetic peptide
GHLRM

SEQ ID NO: 3342 - protein, 4 aa, Artificial Sequence
  Description of Artificial Sequence: Synthetic peptide
ITLM

SEQ ID NO: 3343 - protein, 5 aa, Artificial Sequence
  Description of Artificial Sequence: Synthetic peptide
AHLVK

SEQ ID NO: 3344 - protein, 5 aa, Artificial Sequence
  Description of Artificial Sequence: Synthetic peptide
THLRL

SEQ ID NO: 3345 - protein, 5 aa, Artificial Sequence
  Description of Artificial Sequence: Synthetic peptide
GKLKV

SEQ ID NO: 3346 - protein, 5 aa, Artificial Sequence
  Description of Artificial Sequence: Synthetic peptide
GHLKL

SEQ ID NO: 3347 - protein, 5 aa, Artificial Sequence
  Description of Artificial Sequence: Synthetic peptide
AHLRR

SEQ ID NO: 3348 - protein, 5 aa, Artificial Sequence
  Description of Artificial Sequence: Synthetic peptide
GHLIK

SEQ ID NO: 3349 - protein, 5 aa, Artificial Sequence
  Description of Artificial Sequence: Synthetic peptide
EHLVR

SEQ ID NO: 3350 - protein, 5 aa, Artificial Sequence
  Description of Artificial Sequence: Synthetic peptide
GKLRV

SEQ ID NO: 3351 - protein, 5 aa, Artificial Sequence
  Description of Artificial Sequence: Synthetic peptide
TALSM

SEQ ID NO: 3352 - protein, 5 aa, Artificial Sequence
  Description of Artificial Sequence: Synthetic peptide
EHLQR

SEQ ID NO: 3353 - protein, 5 aa, Artificial Sequence
  Description of Artificial Sequence: Synthetic peptide
EKLKV

SEQ ID NO: 3354 - protein, 5 aa, Artificial Sequence
  Description of Artificial Sequence: Synthetic peptide
QHLVK

SEQ ID NO: 3355 - protein, 5 aa, Artificial Sequence
  Description of Artificial Sequence: Synthetic peptide
TKLNL

SEQ ID NO: 3356 - protein, 5 aa, Artificial Sequence
  Description of Artificial Sequence: Synthetic peptide
GHLRA

SEQ ID NO: 3357 - protein, 5 aa, Artificial Sequence
  Description of Artificial Sequence: Synthetic peptide
GRLPK

SEQ ID NO: 3358 - protein, 5 aa, Artificial Sequence
  Description of Artificial Sequence: Synthetic peptide
SKLKL

SEQ ID NO: 3359 - protein, 5 aa, Artificial Sequence
  Description of Artificial Sequence: Synthetic peptide
THLTK

SEQ ID NO: 3360 - protein, 5 aa, Artificial Sequence
  Description of Artificial Sequence: Synthetic peptide
RLLSG

SEQ ID NO: 3361 - protein, 5 aa, Artificial Sequence
  Description of Artificial Sequence: Synthetic peptide
TKLRI

SEQ ID NO: 3362 - protein, 5 aa, Artificial Sequence
  Description of Artificial Sequence: Synthetic peptide
AHLRI

SEQ ID NO: 3363 - protein, 5 aa, Artificial Sequence
  Description of Artificial Sequence: Synthetic peptide
GHLRV

SEQ ID NO: 3364 - protein, 5 aa, Artificial Sequence
  Description of Artificial Sequence: Synthetic peptide
GLLPG

SEQ ID NO: 3365 - protein, 5 aa, Artificial Sequence
  Description of Artificial Sequence: Synthetic peptide
AKLRT

SEQ ID NO: 3366 - protein, 5 aa, Artificial Sequence
  Description of Artificial Sequence: Synthetic peptide
RHLRV

SEQ ID NO: 3367 - protein, 5 aa, Artificial Sequence
  Description of Artificial Sequence: Synthetic peptide
AALRK

SEQ ID NO: 3368 - protein, 5 aa, Artificial Sequence
  Description of Artificial Sequence: Synthetic peptide
AHLHK

SEQ ID NO: 3369 - protein, 5 aa, Artificial Sequence
  Description of Artificial Sequence: Synthetic peptide
GHLTK

SEQ ID NO: 3370 - protein, 5 aa, Artificial Sequence
  Description of Artificial Sequence: Synthetic peptide
QHLRR

SEQ ID NO: 3371 - protein, 4 aa, Artificial Sequence
  Description of Artificial Sequence: Synthetic peptide
RSHS

SEQ ID NO: 3372 - protein, 5 aa, Artificial Sequence
  Description of Artificial Sequence: Synthetic peptide
SHLNK

SEQ ID NO: 3373 - protein, 5 aa, Artificial Sequence
  Description of Artificial Sequence: Synthetic peptide
AHLQK

SEQ ID NO: 3374 - protein, 5 aa, Artificial Sequence
  Description of Artificial Sequence: Synthetic peptide
GHLMK

SEQ ID NO: 3375 - protein, 5 aa, Artificial Sequence
  Description of Artificial Sequence: Synthetic peptide
SKLRT

SEQ ID NO: 3376 - protein, 5 aa, Artificial Sequence
  Description of Artificial Sequence: Synthetic peptide
AHLRA

SEQ ID NO: 3377 - protein, 5 aa, Artificial Sequence
  Description of Artificial Sequence: Synthetic peptide
EHLRL

SEQ ID NO: 3378 - protein, 5 aa, Artificial Sequence
  Description of Artificial Sequence: Synthetic peptide
GHLKI

SEQ ID NO: 3379 - protein, 5 aa, Artificial Sequence
  Description of Artificial Sequence: Synthetic peptide
SHLKL

SEQ ID NO: 3380 - protein, 5 aa, Artificial Sequence
  Description of Artificial Sequence: Synthetic peptide
EHLKK

SEQ ID NO: 3381 - protein, 5 aa, Artificial Sequence
  Description of Artificial Sequence: Synthetic peptide
GHLRT

SEQ ID NO: 3382 - protein, 5 aa, Artificial Sequence
  Description of Artificial Sequence: Synthetic peptide
GKLKM

SEQ ID NO: 3383 - protein, 5 aa, Artificial Sequence
  Description of Artificial Sequence: Synthetic peptide
HHLKK

SEQ ID NO: 3384 - protein, 5 aa, Artificial Sequence
  Description of Artificial Sequence: Synthetic peptide
SKLTI

SEQ ID NO: 3385 - protein, 5 aa, Artificial Sequence
  Description of Artificial Sequence: Synthetic peptide
THEKP

SEQ ID NO: 3386 - protein, 5 aa, Artificial Sequence
  Description of Artificial Sequence: Synthetic peptide
AKLIL

SEQ ID NO: 3387 - protein, 5 aa, Artificial Sequence
  Description of Artificial Sequence: Synthetic peptide
AKLTI

SEQ ID NO: 3388 - protein, 5 aa, Artificial Sequence
  Description of Artificial Sequence: Synthetic peptide
HALAA

SEQ ID NO: 3389 - protein, 5 aa, Artificial Sequence
  Description of Artificial Sequence: Synthetic peptide
TKLQV

SEQ ID NO: 3390 - protein, 5 aa, Artificial Sequence
  Description of Artificial Sequence: Synthetic peptide
AKLRM

SEQ ID NO: 3391 - protein, 5 aa, Artificial Sequence
  Description of Artificial Sequence: Synthetic peptide
EHLRI

SEQ ID NO: 3392 - protein, 5 aa, Artificial Sequence
  Description of Artificial Sequence: Synthetic peptide
GHLAK

SEQ ID NO: 3393 - protein, 5 aa, Artificial Sequence
  Description of Artificial Sequence: Synthetic peptide
GHLKR

SEQ ID NO: 3394 - protein, 5 aa, Artificial Sequence
  Description of Artificial Sequence: Synthetic peptide
GKLTL

SEQ ID NO: 3395 - protein, 5 aa, Artificial Sequence
  Description of Artificial Sequence: Synthetic peptide
SHLKK

SEQ ID NO: 3396 - protein, 5 aa, Artificial Sequence
  Description of Artificial Sequence: Synthetic peptide
SHLRR

SEQ ID NO: 3397 - protein, 5 aa, Artificial Sequence
  Description of Artificial Sequence: Synthetic peptide
AILKA

SEQ ID NO: 3398 - protein, 5 aa, Artificial Sequence
  Description of Artificial Sequence: Synthetic peptide
AKLTL

SEQ ID NO: 3399 - protein, 5 aa, Artificial Sequence
  Description of Artificial Sequence: Synthetic peptide
ASLTG

SEQ ID NO: 3400 - protein, 5 aa, Artificial Sequence
  Description of Artificial Sequence: Synthetic peptide
EVLTM

SEQ ID NO: 3401 - protein, 5 aa, Artificial Sequence
  Description of Artificial Sequence: Synthetic peptide
GHLKT

SEQ ID NO: 3402 - protein, 4 aa, Artificial Sequence
  Description of Artificial Sequence: Synthetic peptide
NGRS

SEQ ID NO: 3403 - protein, 5 aa, Artificial Sequence
  Description of Artificial Sequence: Synthetic peptide
THLRR

SEQ ID NO: 3404 - protein, 5 aa, Artificial Sequence
  Description of Artificial Sequence: Synthetic peptide
AHLKL

SEQ ID NO: 3405 - protein, 5 aa, Artificial Sequence
  Description of Artificial Sequence: Synthetic peptide
GALVH

SEQ ID NO: 3406 - protein, 5 aa, Artificial Sequence
  Description of Artificial Sequence: Synthetic peptide
GKLVL

SEQ ID NO: 3407 - protein, 6 aa, Artificial Sequence
  Description of Artificial Sequence: Synthetic peptide
NGRSPV

SEQ ID NO: 3408 - protein, 5 aa, Artificial Sequence
  Description of Artificial Sequence: Synthetic peptide
QALSI

SEQ ID NO: 3409 - protein, 5 aa, Artificial Sequence
  Description of Artificial Sequence: Synthetic peptide
SHLRT

SEQ ID NO: 3410 - protein, 5 aa, Artificial Sequence
  Description of Artificial Sequence: Synthetic peptide
AALRL

SEQ ID NO: 3411 - protein, 5 aa, Artificial Sequence
  Description of Artificial Sequence: Synthetic peptide
AHLMK

SEQ ID NO: 3412 - protein, 5 aa, Artificial Sequence
  Description of Artificial Sequence: Synthetic peptide
AHLRQ

SEQ ID NO: 3413 - protein, 5 aa, Artificial Sequence
  Description of Artificial Sequence: Synthetic peptide
AKLNL

SEQ ID NO: 3414 - protein, 5 aa, Artificial Sequence
  Description of Artificial Sequence: Synthetic peptide
AKLRA

SEQ ID NO: 3415 - protein, 5 aa, Artificial Sequence
  Description of Artificial Sequence: Synthetic peptide
APLRK

SEQ ID NO: 3416 - protein, 5 aa, Artificial Sequence
  Description of Artificial Sequence: Synthetic peptide
GALMG

SEQ ID NO: 3417 - protein, 5 aa, Artificial Sequence
  Description of Artificial Sequence: Synthetic peptide
GALTG

SEQ ID NO: 3418 - protein, 5 aa, Artificial Sequence
  Description of Artificial Sequence: Synthetic peptide
GHLRG

SEQ ID NO: 3419 - protein, 5 aa, Artificial Sequence
  Description of Artificial Sequence: Synthetic peptide
GHLTL

SEQ ID NO: 3420 - protein, 5 aa, Artificial Sequence
  Description of Artificial Sequence: Synthetic peptide
GKLRK

SEQ ID NO: 3421 - protein, 5 aa, Artificial Sequence
  Description of Artificial Sequence: Synthetic peptide
GKLTV

SEQ ID NO: 3422 - protein, 5 aa, Artificial Sequence
  Description of Artificial Sequence: Synthetic peptide
HHLRK

SEQ ID NO: 3423 - protein, 5 aa, Artificial Sequence
  Description of Artificial Sequence: Synthetic peptide
MGLVG

SEQ ID NO: 3424 - protein, 5 aa, Artificial Sequence
  Description of Artificial Sequence: Synthetic peptide
SHLRI

SEQ ID NO: 3425 - protein, 5 aa, Artificial Sequence
  Description of Artificial Sequence: Synthetic peptide
SKLIL

SEQ ID NO: 3426 - protein, 5 aa, Artificial Sequence
  Description of Artificial Sequence: Synthetic peptide
SKLMV

SEQ ID NO: 3427 - protein, 5 aa, Artificial Sequence
  Description of Artificial Sequence: Synthetic peptide
SLLAG

SEQ ID NO: 3428 - protein, 5 aa, Artificial Sequence
  Description of Artificial Sequence: Synthetic peptide
THLKI

SEQ ID NO: 3429 - protein, 5 aa, Artificial Sequence
  Description of Artificial Sequence: Synthetic peptide
THLQK

SEQ ID NO: 3430 - protein, 5 aa, Artificial Sequence
  Description of Artificial Sequence: Synthetic peptide
VPLAG

SEQ ID NO: 3431 - protein, 5 aa, Artificial Sequence
  Description of Artificial Sequence: Synthetic peptide
AGLLG

SEQ ID NO: 3432 - protein, 5 aa, Artificial Sequence
  Description of Artificial Sequence: Synthetic peptide
AHLKM

SEQ ID NO: 3433 - protein, 5 aa, Artificial Sequence
  Description of Artificial Sequence: Synthetic peptide
AHLRN

SEQ ID NO: 3434 - protein, 5 aa, Artificial Sequence
  Description of Artificial Sequence: Synthetic peptide
AHLTK

SEQ ID NO: 3435 - protein, 5 aa, Artificial Sequence
  Description of Artificial Sequence: Synthetic peptide
AKLIV

SEQ ID NO: 3436 - protein, 5 aa, Artificial Sequence
  Description of Artificial Sequence: Synthetic peptide
AKLKA

SEQ ID NO: 3437 - protein, 5 aa, Artificial Sequence
  Description of Artificial Sequence: Synthetic peptide
AKLTV

SEQ ID NO: 3438 - protein, 5 aa, Artificial Sequence
  Description of Artificial Sequence: Synthetic peptide
AKLVL

SEQ ID NO: 3439 - protein, 5 aa, Artificial Sequence
  Description of Artificial Sequence: Synthetic peptide
AKSRI

SEQ ID NO: 3440 - protein, 5 aa, Artificial Sequence
  Description of Artificial Sequence: Synthetic peptide
AMLMQ

SEQ ID NO: 3441 - protein, 5 aa, Artificial Sequence
  Description of Artificial Sequence: Synthetic peptide
AQLRI

SEQ ID NO: 3442 - protein, 4 aa, Artificial Sequence
  Description of Artificial Sequence: Synthetic peptide
DALR

SEQ ID NO: 3443 - protein, 5 aa, Artificial Sequence
  Description of Artificial Sequence: Synthetic peptide
EKLKL

SEQ ID NO: 3444 - protein, 5 aa, Artificial Sequence
  Description of Artificial Sequence: Synthetic peptide
GGLQK

SEQ ID NO: 3445 - protein, 5 aa, Artificial Sequence
  Description of Artificial Sequence: Synthetic peptide
GGLTM

SEQ ID NO: 3446 - protein, 5 aa, Artificial Sequence
  Description of Artificial Sequence: Synthetic peptide
GHLLR

SEQ ID NO: 3447 - protein, 5 aa, Artificial Sequence
  Description of Artificial Sequence: Synthetic peptide
GHLRI

SEQ ID NO: 3448 - protein, 5 aa, Artificial Sequence
  Description of Artificial Sequence: Synthetic peptide
GHLVG

SEQ ID NO: 3449 - protein, 5 aa, Artificial Sequence
  Description of Artificial Sequence: Synthetic peptide
GHLVR

SEQ ID NO: 3450 - protein, 5 aa, Artificial Sequence
  Description of Artificial Sequence: Synthetic peptide
GKLNL

SEQ ID NO: 3451 - protein, 5 aa, Artificial Sequence
  Description of Artificial Sequence: Synthetic peptide
GKLVP

SEQ ID NO: 3452 - protein, 5 aa, Artificial Sequence
  Description of Artificial Sequence: Synthetic peptide
GLLGL

SEQ ID NO: 3453 - protein, 5 aa, Artificial Sequence
  Description of Artificial Sequence: Synthetic peptide
GNLGM

SEQ ID NO: 3454 - protein, 5 aa, Artificial Sequence
  Description of Artificial Sequence: Synthetic peptide
GVLQK

SEQ ID NO: 3455 - protein, 5 aa, Artificial Sequence
  Description of Artificial Sequence: Synthetic peptide
HGLLP

SEQ ID NO: 3456 - protein, 5 aa, Artificial Sequence
  Description of Artificial Sequence: Synthetic peptide
HLLEN

SEQ ID NO: 3457 - protein, 5 aa, Artificial Sequence
  Description of Artificial Sequence: Synthetic peptide
IGLQR

SEQ ID NO: 3458 - protein, 5 aa, Artificial Sequence
  Description of Artificial Sequence: Synthetic peptide
KTLGV

SEQ ID NO: 3459 - protein, 5 aa, Artificial Sequence
  Description of Artificial Sequence: Synthetic peptide
LSLLK

SEQ ID NO: 3460 - protein, 5 aa, Artificial Sequence
  Description of Artificial Sequence: Synthetic peptide
MRLGE

SEQ ID NO: 3461 - protein, 5 aa, Artificial Sequence
  Description of Artificial Sequence: Synthetic peptide
NSLTR

SEQ ID NO: 3462 - protein, 5 aa, Artificial Sequence
  Description of Artificial Sequence: Synthetic peptide
NVLNK

SEQ ID NO: 3463 - protein, 5 aa, Artificial Sequence
  Description of Artificial Sequence: Synthetic peptide
PHLRK

SEQ ID NO: 3464 - protein, 5 aa, Artificial Sequence
  Description of Artificial Sequence: Synthetic peptide
PLLMP

SEQ ID NO: 3465 - protein, 5 aa, Artificial Sequence
  Description of Artificial Sequence: Synthetic peptide
PRLRH

SEQ ID NO: 3466 - protein, 5 aa, Artificial Sequence
  Description of Artificial Sequence: Synthetic peptide
QKLHL

SEQ ID NO: 3467 - protein, 5 aa, Artificial Sequence
  Description of Artificial Sequence: Synthetic peptide
QKLNL

SEQ ID NO: 3468 - protein, 5 aa, Artificial Sequence
  Description of Artificial Sequence: Synthetic peptide
SHLRV

SEQ ID NO: 3469 - protein, 5 aa, Artificial Sequence
  Description of Artificial Sequence: Synthetic peptide
SKLHL

SEQ ID NO: 3470 - protein, 5 aa, Artificial Sequence
  Description of Artificial Sequence: Synthetic peptide
SKLKR

SEQ ID NO: 3471 - protein, 5 aa, Artificial Sequence
  Description of Artificial Sequence: Synthetic peptide
SKLNL

SEQ ID NO: 3472 - protein, 5 aa, Artificial Sequence
  Description of Artificial Sequence: Synthetic peptide
SPLAE

SEQ ID NO: 3473 - protein, 5 aa, Artificial Sequence
  Description of Artificial Sequence: Synthetic peptide
SVLML

SEQ ID NO: 3474 - protein, 5 aa, Artificial Sequence
  Description of Artificial Sequence: Synthetic peptide
THLRV

SEQ ID NO: 3475 - protein, 5 aa, Artificial Sequence
  Description of Artificial Sequence: Synthetic peptide
TKLIL

SEQ ID NO: 3476 - protein, 5 aa, Artificial Sequence
  Description of Artificial Sequence: Synthetic peptide
TKLMV

SEQ ID NO: 3477 - protein, 5 aa, Artificial Sequence
  Description of Artificial Sequence: Synthetic peptide
TPLNI

SEQ ID NO: 3478 - protein, 5 aa, Artificial Sequence
  Description of Artificial Sequence: Synthetic peptide
TRLQK

SEQ ID NO: 3479 - protein, 5 aa, Artificial Sequence
  Description of Artificial Sequence: Synthetic peptide
VGLGQ

SEQ ID NO: 3480 - protein, 5 aa, Artificial Sequence
  Description of Artificial Sequence: Synthetic peptide
VHLRK

SEQ ID NO: 3481 - protein, 5 aa, Artificial Sequence
  Description of Artificial Sequence: Synthetic peptide
AALES

SEQ ID NO: 3482 - protein, 5 aa, Artificial Sequence
  Description of Artificial Sequence: Synthetic peptide
AALRI

SEQ ID NO: 3483 - protein, 5 aa, Artificial Sequence
  Description of Artificial Sequence: Synthetic peptide
ADLRK

SEQ ID NO: 3484 - protein, 5 aa, Artificial Sequence
  Description of Artificial Sequence: Synthetic peptide
AELLG

SEQ ID NO: 3485 - protein, 5 aa, Artificial Sequence
  Description of Artificial Sequence: Synthetic peptide
AELRI

SEQ ID NO: 3486 - protein, 5 aa, Artificial Sequence
  Description of Artificial Sequence: Synthetic peptide
AGLAA

SEQ ID NO: 3487 - protein, 5 aa, Artificial Sequence
  Description of Artificial Sequence: Synthetic peptide
AGLMD

SEQ ID NO: 3488 - protein, 5 aa, Artificial Sequence
  Description of Artificial Sequence: Synthetic peptide
AHLGL

SEQ ID NO: 3489 - protein, 4 aa, Artificial Sequence
  Description of Artificial Sequence: Synthetic peptide
AHLK

SEQ ID NO: 3490 - protein, 5 aa, Artificial Sequence
  Description of Artificial Sequence: Synthetic peptide
AHLKA

SEQ ID NO: 3491 - protein, 5 aa, Artificial Sequence
  Description of Artificial Sequence: Synthetic peptide
AHLKI

SEQ ID NO: 3492 - protein, 5 aa, Artificial Sequence
  Description of Artificial Sequence: Synthetic peptide
AHLNK

SEQ ID NO: 3493 - protein, 4 aa, Artificial Sequence
  Description of Artificial Sequence: Synthetic peptide
AHLR

SEQ ID NO: 3494 - protein, 5 aa, Artificial Sequence
  Description of Artificial Sequence: Synthetic peptide
AHLSK

SEQ ID NO: 3495 - protein, 5 aa, Artificial Sequence
  Description of Artificial Sequence: Synthetic peptide
AHLSP

SEQ ID NO: 3496 - protein, 5 aa, Artificial Sequence
  Description of Artificial Sequence: Synthetic peptide
AHLWK

SEQ ID NO: 3497 - protein, 5 aa, Artificial Sequence
  Description of Artificial Sequence: Synthetic peptide
AKFKI

SEQ ID NO: 3498 - protein, 5 aa, Artificial Sequence
  Description of Artificial Sequence: Synthetic peptide
AKIKH

SEQ ID NO: 3499 - protein, 5 aa, Artificial Sequence
  Description of Artificial Sequence: Synthetic peptide
AKIRI

SEQ ID NO: 3500 - protein, 5 aa, Artificial Sequence
  Description of Artificial Sequence: Synthetic peptide
AKIRL

SEQ ID NO: 3501 - protein, 5 aa, Artificial Sequence
  Description of Artificial Sequence: Synthetic peptide
AKIRV

SEQ ID NO: 3502 - protein, 5 aa, Artificial Sequence
  Description of Artificial Sequence: Synthetic peptide
AKLHT

SEQ ID NO: 3503 - protein, 5 aa, Artificial Sequence
  Description of Artificial Sequence: Synthetic peptide
AKLKE

SEQ ID NO: 3504 - protein, 5 aa, Artificial Sequence
  Description of Artificial Sequence: Synthetic peptide
AKLKG

SEQ ID NO: 3505 - protein, 5 aa, Artificial Sequence
  Description of Artificial Sequence: Synthetic peptide
AKLKM

SEQ ID NO: 3506 - protein, 5 aa, Artificial Sequence
  Description of Artificial Sequence: Synthetic peptide
AKLMN

SEQ ID NO: 3507 - protein, 5 aa, Artificial Sequence
  Description of Artificial Sequence: Synthetic peptide
AKLNI

SEQ ID NO: 3508 - protein, 5 aa, Artificial Sequence
  Description of Artificial Sequence: Synthetic peptide
AKLQL

SEQ ID NO: 3509 - protein, 5 aa, Artificial Sequence
  Description of Artificial Sequence: Synthetic peptide
AKLRG

SEQ ID NO: 3510 - protein, 5 aa, Artificial Sequence
  Description of Artificial Sequence: Synthetic peptide
AKLRR

SEQ ID NO: 3511 - protein, 5 aa, Artificial Sequence
  Description of Artificial Sequence: Synthetic peptide
AKLSM

SEQ ID NO: 3512 - protein, 5 aa, Artificial Sequence
  Description of Artificial Sequence: Synthetic peptide
AKSRV

SEQ ID NO: 3513 - protein, 5 aa, Artificial Sequence
  Description of Artificial Sequence: Synthetic peptide
AKVKL

SEQ ID NO: 3514 - protein, 5 aa, Artificial Sequence
  Description of Artificial Sequence: Synthetic peptide
AKVRI

SEQ ID NO: 3515 - protein, 5 aa, Artificial Sequence
  Description of Artificial Sequence: Synthetic peptide
ALLMA

SEQ ID NO: 3516 - protein, 5 aa, Artificial Sequence
  Description of Artificial Sequence: Synthetic peptide
ALLRR

SEQ ID NO: 3517 - protein, 5 aa, Artificial Sequence
  Description of Artificial Sequence: Synthetic peptide
AMLIM

SEQ ID NO: 3518 - protein, 5 aa, Artificial Sequence
  Description of Artificial Sequence: Synthetic peptide
AMLKI

SEQ ID NO: 3519 - protein, 5 aa, Artificial Sequence
  Description of Artificial Sequence: Synthetic peptide
AMLRG

SEQ ID NO: 3520 - protein, 5 aa, Artificial Sequence
  Description of Artificial Sequence: Synthetic peptide
AMLRL

SEQ ID NO: 3521 - protein, 5 aa, Artificial Sequence
  Description of Artificial Sequence: Synthetic peptide
ANLSN

SEQ ID NO: 3522 - protein, 5 aa, Artificial Sequence
  Description of Artificial Sequence: Synthetic peptide
ANVAQ

SEQ ID NO: 3523 - protein, 5 aa, Artificial Sequence
  Description of Artificial Sequence: Synthetic peptide
APLKK

SEQ ID NO: 3524 - protein, 5 aa, Artificial Sequence
  Description of Artificial Sequence: Synthetic peptide
AQFRK

SEQ ID NO: 3525 - protein, 5 aa, Artificial Sequence
  Description of Artificial Sequence: Synthetic peptide
AQLVD

SEQ ID NO: 3526 - protein, 5 aa, Artificial Sequence
  Description of Artificial Sequence: Synthetic peptide
ARLAG

SEQ ID NO: 3527 - protein, 5 aa, Artificial Sequence
  Description of Artificial Sequence: Synthetic peptide
ARLGT

SEQ ID NO: 3528 - protein, 5 aa, Artificial Sequence
  Description of Artificial Sequence: Synthetic peptide
ARLRA

SEQ ID NO: 3529 - protein, 5 aa, Artificial Sequence
  Description of Artificial Sequence: Synthetic peptide
ARLRK

SEQ ID NO: 3530 - protein, 5 aa, Artificial Sequence
  Description of Artificial Sequence: Synthetic peptide
ASLRM

SEQ ID NO: 3531 - protein, 5 aa, Artificial Sequence
  Description of Artificial Sequence: Synthetic peptide
ATLKL

SEQ ID NO: 3532 - protein, 5 aa, Artificial Sequence
  Description of Artificial Sequence: Synthetic peptide
ATLRV

SEQ ID NO: 3533 - protein, 4 aa, Artificial Sequence
  Description of Artificial Sequence: Synthetic peptide
CLKI

SEQ ID NO: 3534 - protein, 5 aa, Artificial Sequence
  Description of Artificial Sequence: Synthetic peptide
DELMR

SEQ ID NO: 3535 - protein, 5 aa, Artificial Sequence
  Description of Artificial Sequence: Synthetic peptide
DELRV

SEQ ID NO: 3536 - protein, 5 aa, Artificial Sequence
  Description of Artificial Sequence: Synthetic peptide
DGLES

SEQ ID NO: 3537 - protein, 5 aa, Artificial Sequence
  Description of Artificial Sequence: Synthetic peptide
DGLMD

SEQ ID NO: 3538 - protein, 5 aa, Artificial Sequence
  Description of Artificial Sequence: Synthetic peptide
DGLVG

SEQ ID NO: 3539 - protein, 5 aa, Artificial Sequence
  Description of Artificial Sequence: Synthetic peptide
DHLKK

SEQ ID NO: 3540 - protein, 5 aa, Artificial Sequence
  Description of Artificial Sequence: Synthetic peptide
DHLRK

SEQ ID NO: 3541 - protein, 5 aa, Artificial Sequence
  Description of Artificial Sequence: Synthetic peptide
DHLRR

SEQ ID NO: 3542 - protein, 5 aa, Artificial Sequence
  Description of Artificial Sequence: Synthetic peptide
DKLRK

SEQ ID NO: 3543 - protein, 5 aa, Artificial Sequence
  Description of Artificial Sequence: Synthetic peptide
DLLGV

SEQ ID NO: 3544 - protein, 5 aa, Artificial Sequence
  Description of Artificial Sequence: Synthetic peptide
DLLLN

SEQ ID NO: 3545 - protein, 5 aa, Artificial Sequence
  Description of Artificial Sequence: Synthetic peptide
DNLRE

SEQ ID NO: 3546 - protein, 5 aa, Artificial Sequence
  Description of Artificial Sequence: Synthetic peptide
DPLAR

SEQ ID NO: 3547 - protein, 5 aa, Artificial Sequence
  Description of Artificial Sequence: Synthetic peptide
DSLGE

SEQ ID NO: 3548 - protein, 5 aa, Artificial Sequence
  Description of Artificial Sequence: Synthetic peptide
EALMA

SEQ ID NO: 3549 - protein, 5 aa, Artificial Sequence
  Description of Artificial Sequence: Synthetic peptide
EDLVK

SEQ ID NO: 3550 - protein, 5 aa, Artificial Sequence
  Description of Artificial Sequence: Synthetic peptide
EELGL

SEQ ID NO: 3551 - protein, 5 aa, Artificial Sequence
  Description of Artificial Sequence: Synthetic peptide
EELMM

SEQ ID NO: 3552 - protein, 5 aa, Artificial Sequence
  Description of Artificial Sequence: Synthetic peptide
EGLVE

SEQ ID NO: 3553 - protein, 4 aa, Artificial Sequence
  Description of Artificial Sequence: Synthetic peptide
EHLG

SEQ ID NO: 3554 - protein, 5 aa, Artificial Sequence
  Description of Artificial Sequence: Synthetic peptide
EHLHK

SEQ ID NO: 3555 - protein, 5 aa, Artificial Sequence
  Description of Artificial Sequence: Synthetic peptide
EHLKL

SEQ ID NO: 3556 - protein, 5 aa, Artificial Sequence
  Description of Artificial Sequence: Synthetic peptide
EHLKM

SEQ ID NO: 3557 - protein, 5 aa, Artificial Sequence
  Description of Artificial Sequence: Synthetic peptide
EHLRS

SEQ ID NO: 3558 - protein, 5 aa, Artificial Sequence
  Description of Artificial Sequence: Synthetic peptide
EHLSE

SEQ ID NO: 3559 - protein, 5 aa, Artificial Sequence
  Description of Artificial Sequence: Synthetic peptide
EHLSR

SEQ ID NO: 3560 - protein, 5 aa, Artificial Sequence
  Description of Artificial Sequence: Synthetic peptide
EHLTK

SEQ ID NO: 3561 - protein, 5 aa, Artificial Sequence
  Description of Artificial Sequence: Synthetic peptide
EHLVK

SEQ ID NO: 3562 - protein, 5 aa, Artificial Sequence
  Description of Artificial Sequence: Synthetic peptide
EQLGP

SEQ ID NO: 3563 - protein, 5 aa, Artificial Sequence
  Description of Artificial Sequence: Synthetic peptide
ERLAA

SEQ ID NO: 3564 - protein, 5 aa, Artificial Sequence
  Description of Artificial Sequence: Synthetic peptide
ERLGR

SEQ ID NO: 3565 - protein, 5 aa, Artificial Sequence
  Description of Artificial Sequence: Synthetic peptide
ESLMA

SEQ ID NO: 3566 - protein, 5 aa, Artificial Sequence
  Description of Artificial Sequence: Synthetic peptide
ETLSH

SEQ ID NO: 3567 - protein, 5 aa, Artificial Sequence
  Description of Artificial Sequence: Synthetic peptide
EVLGI

SEQ ID NO: 3568 - protein, 5 aa, Artificial Sequence
  Description of Artificial Sequence: Synthetic peptide
FFLRV

SEQ ID NO: 3569 - protein, 5 aa, Artificial Sequence
  Description of Artificial Sequence: Synthetic peptide
GALGR

SEQ ID NO: 3570 - protein, 5 aa, Artificial Sequence
  Description of Artificial Sequence: Synthetic peptide
GALIM

SEQ ID NO: 3571 - protein, 5 aa, Artificial Sequence
  Description of Artificial Sequence: Synthetic peptide
GDLSG

SEQ ID NO: 3572 - protein, 5 aa, Artificial Sequence
  Description of Artificial Sequence: Synthetic peptide
GGLDL

SEQ ID NO: 3573 - protein, 5 aa, Artificial Sequence
  Description of Artificial Sequence: Synthetic peptide
GGLDQ

SEQ ID NO: 3574 - protein, 5 aa, Artificial Sequence
  Description of Artificial Sequence: Synthetic peptide
GGLNM

SEQ ID NO: 3575 - protein, 5 aa, Artificial Sequence
  Description of Artificial Sequence: Synthetic peptide
GGLPE

SEQ ID NO: 3576 - protein, 5 aa, Artificial Sequence
  Description of Artificial Sequence: Synthetic peptide
GHFKT

SEQ ID NO: 3577 - protein, 5 aa, Artificial Sequence
  Description of Artificial Sequence: Synthetic peptide
GHFQN

SEQ ID NO: 3578 - protein, 4 aa, Artificial Sequence
  Description of Artificial Sequence: Synthetic peptide
GHLK

SEQ ID NO: 3579 - protein, 5 aa, Artificial Sequence
  Description of Artificial Sequence: Synthetic peptide
GHLMN

SEQ ID NO: 3580 - protein, 5 aa, Artificial Sequence
  Description of Artificial Sequence: Synthetic peptide
GHLMV

SEQ ID NO: 3581 - protein, 4 aa, Artificial Sequence
  Description of Artificial Sequence: Synthetic peptide
GHLR

SEQ ID NO: 3582 - protein, 5 aa, Artificial Sequence
  Description of Artificial Sequence: Synthetic peptide
GILAG

SEQ ID NO: 3583 - protein, 5 aa, Artificial Sequence
  Description of Artificial Sequence: Synthetic peptide
GKLHE

SEQ ID NO: 3584 - protein, 5 aa, Artificial Sequence
  Description of Artificial Sequence: Synthetic peptide
GKLKA

SEQ ID NO: 3585 - protein, 5 aa, Artificial Sequence
  Description of Artificial Sequence: Synthetic peptide
GKLKF

SEQ ID NO: 3586 - protein, 5 aa, Artificial Sequence
  Description of Artificial Sequence: Synthetic peptide
GKLKT

SEQ ID NO: 3587 - protein, 4 aa, Artificial Sequence
  Description of Artificial Sequence: Synthetic peptide
GKLR

SEQ ID NO: 3588 - protein, 5 aa, Artificial Sequence
  Description of Artificial Sequence: Synthetic peptide
GKLRA

SEQ ID NO: 3589 - protein, 5 aa, Artificial Sequence
  Description of Artificial Sequence: Synthetic peptide
GKLRM

SEQ ID NO: 3590 - protein, 5 aa, Artificial Sequence
  Description of Artificial Sequence: Synthetic peptide
GKLVA

SEQ ID NO: 3591 - protein, 5 aa, Artificial Sequence
  Description of Artificial Sequence: Synthetic peptide
GKLVV

SEQ ID NO: 3592 - protein, 5 aa, Artificial Sequence
  Description of Artificial Sequence: Synthetic peptide
GLLGE

SEQ ID NO: 3593 - protein, 5 aa, Artificial Sequence
  Description of Artificial Sequence: Synthetic peptide
GLLLD

SEQ ID NO: 3594 - protein, 5 aa, Artificial Sequence
  Description of Artificial Sequence: Synthetic peptide
GLLMG

SEQ ID NO: 3595 - protein, 5 aa, Artificial Sequence
  Description of Artificial Sequence: Synthetic peptide
GLLRG

SEQ ID NO: 3596 - protein, 5 aa, Artificial Sequence
  Description of Artificial Sequence: Synthetic peptide
GMLGG

SEQ ID NO: 3597 - protein, 5 aa, Artificial Sequence
  Description of Artificial Sequence: Synthetic peptide
GPLGV

SEQ ID NO: 3598 - protein, 5 aa, Artificial Sequence
  Description of Artificial Sequence: Synthetic peptide
GPLRV

SEQ ID NO: 3599 - protein, 5 aa, Artificial Sequence
  Description of Artificial Sequence: Synthetic peptide
GRLKI

SEQ ID NO: 3600 - protein, 5 aa, Artificial Sequence
  Description of Artificial Sequence: Synthetic peptide
GRLKK

SEQ ID NO: 3601 - protein, 5 aa, Artificial Sequence
  Description of Artificial Sequence: Synthetic peptide
GSLST

SEQ ID NO: 3602 - protein, 5 aa, Artificial Sequence
  Description of Artificial Sequence: Synthetic peptide
GSLVK

SEQ ID NO: 3603 - protein, 5 aa, Artificial Sequence
  Description of Artificial Sequence: Synthetic peptide
GVLAG

SEQ ID NO: 3604 - protein, 5 aa, Artificial Sequence
  Description of Artificial Sequence: Synthetic peptide
GVLLV

SEQ ID NO: 3605 - protein, 4 aa, Artificial Sequence
  Description of Artificial Sequence: Synthetic peptide
GVLS

SEQ ID NO: 3606 - protein, 5 aa, Artificial Sequence
  Description of Artificial Sequence: Synthetic peptide
GYLRK

SEQ ID NO: 3607 - protein, 5 aa, Artificial Sequence
  Description of Artificial Sequence: Synthetic peptide
HALRT

SEQ ID NO: 3608 - protein, 5 aa, Artificial Sequence
  Description of Artificial Sequence: Synthetic peptide
HALVN

SEQ ID NO: 3609 - protein, 5 aa, Artificial Sequence
  Description of Artificial Sequence: Synthetic peptide
HGLTG

SEQ ID NO: 3610 - protein, 5 aa, Artificial Sequence
  Description of Artificial Sequence: Synthetic peptide
HHLAK

SEQ ID NO: 3611 - protein, 5 aa, Artificial Sequence
  Description of Artificial Sequence: Synthetic peptide
HHLRR

SEQ ID NO: 3612 - protein, 4 aa, Artificial Sequence
  Description of Artificial Sequence: Synthetic peptide
HIRS

SEQ ID NO: 3613 - protein, 5 aa, Artificial Sequence
  Description of Artificial Sequence: Synthetic peptide
HTHEK

SEQ ID NO: 3614 - protein, 5 aa, Artificial Sequence
  Description of Artificial Sequence: Synthetic peptide
IELVQ

SEQ ID NO: 3615 - protein, 5 aa, Artificial Sequence
  Description of Artificial Sequence: Synthetic peptide
IGLGL

SEQ ID NO: 3616 - protein, 5 aa, Artificial Sequence
  Description of Artificial Sequence: Synthetic peptide
IKLRL

SEQ ID NO: 3617 - protein, 5 aa, Artificial Sequence
  Description of Artificial Sequence: Synthetic peptide
IMLRE

SEQ ID NO: 3618 - protein, 5 aa, Artificial Sequence
  Description of Artificial Sequence: Synthetic peptide
IMLVE

SEQ ID NO: 3619 - protein, 5 aa, Artificial Sequence
  Description of Artificial Sequence: Synthetic peptide
IPLGD

SEQ ID NO: 3620 - protein, 5 aa, Artificial Sequence
  Description of Artificial Sequence: Synthetic peptide
IQLRK

SEQ ID NO: 3621 - protein, 4 aa, Artificial Sequence
  Description of Artificial Sequence: Synthetic peptide
IRLG

SEQ ID NO: 3622 - protein, 5 aa, Artificial Sequence
  Description of Artificial Sequence: Synthetic peptide
IRLGG

SEQ ID NO: 3623 - protein, 5 aa, Artificial Sequence
  Description of Artificial Sequence: Synthetic peptide
IRLVV

SEQ ID NO: 3624 - protein, 5 aa, Artificial Sequence
  Description of Artificial Sequence: Synthetic peptide
IVLAA

SEQ ID NO: 3625 - protein, 5 aa, Artificial Sequence
  Description of Artificial Sequence: Synthetic peptide
KHLRA

SEQ ID NO: 3626 - protein, 5 aa, Artificial Sequence
  Description of Artificial Sequence: Synthetic peptide
KHLRL

SEQ ID NO: 3627 - protein, 5 aa, Artificial Sequence
  Description of Artificial Sequence: Synthetic peptide
KILPE

SEQ ID NO: 3628 - protein, 5 aa, Artificial Sequence
  Description of Artificial Sequence: Synthetic peptide
KKLLE

SEQ ID NO: 3629 - protein, 5 aa, Artificial Sequence
  Description of Artificial Sequence: Synthetic peptide
KMLPP

SEQ ID NO: 3630 - protein, 5 aa, Artificial Sequence
  Description of Artificial Sequence: Synthetic peptide
KNLIK

SEQ ID NO: 3631 - protein, 5 aa, Artificial Sequence
  Description of Artificial Sequence: Synthetic peptide
KSLMP

SEQ ID NO: 3632 - protein, 5 aa, Artificial Sequence
  Description of Artificial Sequence: Synthetic peptide
LALGG

SEQ ID NO: 3633 - protein, 5 aa, Artificial Sequence
  Description of Artificial Sequence: Synthetic peptide
LGLGA

SEQ ID NO: 3634 - protein, 5 aa, Artificial Sequence
  Description of Artificial Sequence: Synthetic peptide
LGLVG

SEQ ID NO: 3635 - protein, 5 aa, Artificial Sequence
  Description of Artificial Sequence: Synthetic peptide
LHLTK

SEQ ID NO: 3636 - protein, 5 aa, Artificial Sequence
  Description of Artificial Sequence: Synthetic peptide
LRLIG

SEQ ID NO: 3637 - protein, 5 aa, Artificial Sequence
  Description of Artificial Sequence: Synthetic peptide
LTLQR

SEQ ID NO: 3638 - protein, 5 aa, Artificial Sequence
  Description of Artificial Sequence: Synthetic peptide
LVLRR

SEQ ID NO: 3639 - protein, 6 aa, Artificial Sequence
  Description of Artificial Sequence: Synthetic peptide
MASHMK

SEQ ID NO: 3640 - protein, 5 aa, Artificial Sequence
  Description of Artificial Sequence: Synthetic peptide
MALRL

SEQ ID NO: 3641 - protein, 5 aa, Artificial Sequence
  Description of Artificial Sequence: Synthetic peptide
MALTR

SEQ ID NO: 3642 - protein, 5 aa, Artificial Sequence
  Description of Artificial Sequence: Synthetic peptide
MGLDP

SEQ ID NO: 3643 - protein, 5 aa, Artificial Sequence
  Description of Artificial Sequence: Synthetic peptide
MGLGE

SEQ ID NO: 3644 - protein, 5 aa, Artificial Sequence
  Description of Artificial Sequence: Synthetic peptide
MGLQN

SEQ ID NO: 3645 - protein, 5 aa, Artificial Sequence
  Description of Artificial Sequence: Synthetic peptide
MHLRM

SEQ ID NO: 3646 - protein, 5 aa, Artificial Sequence
  Description of Artificial Sequence: Synthetic peptide
MKLEQ

SEQ ID NO: 3647 - protein, 5 aa, Artificial Sequence
  Description of Artificial Sequence: Synthetic peptide
MLLRN

SEQ ID NO: 3648 - protein, 5 aa, Artificial Sequence
  Description of Artificial Sequence: Synthetic peptide
MLLSH

SEQ ID NO: 3649 - protein, 5 aa, Artificial Sequence
  Description of Artificial Sequence: Synthetic peptide
MLLVN

SEQ ID NO: 3650 - protein, 5 aa, Artificial Sequence
  Description of Artificial Sequence: Synthetic peptide
MPLRA

SEQ ID NO: 3651 - protein, 5 aa, Artificial Sequence
  Description of Artificial Sequence: Synthetic peptide
MQLGG

SEQ ID NO: 3652 - protein, 5 aa, Artificial Sequence
  Description of Artificial Sequence: Synthetic peptide
MRLAR

SEQ ID NO: 3653 - protein, 5 aa, Artificial Sequence
  Description of Artificial Sequence: Synthetic peptide
MRLMG

SEQ ID NO: 3654 - protein, 5 aa, Artificial Sequence
  Description of Artificial Sequence: Synthetic peptide
MRLVG

SEQ ID NO: 3655 - protein, 5 aa, Artificial Sequence
  Description of Artificial Sequence: Synthetic peptide
MSLER

SEQ ID NO: 3656 - protein, 5 aa, Artificial Sequence
  Description of Artificial Sequence: Synthetic peptide
MTLPL

SEQ ID NO: 3657 - protein, 5 aa, Artificial Sequence
  Description of Artificial Sequence: Synthetic peptide
MTLSD

SEQ ID NO: 3658 - protein, 5 aa, Artificial Sequence
  Description of Artificial Sequence: Synthetic peptide
MVLAG

SEQ ID NO: 3659 - protein, 5 aa, Artificial Sequence
  Description of Artificial Sequence: Synthetic peptide
NKLRL

SEQ ID NO: 3660 - protein, 4 aa, Artificial Sequence
  Description of Artificial Sequence: Synthetic peptide
NLAH

SEQ ID NO: 3661 - protein, 5 aa, Artificial Sequence
  Description of Artificial Sequence: Synthetic peptide
NLLPT

SEQ ID NO: 3662 - protein, 5 aa, Artificial Sequence
  Description of Artificial Sequence: Synthetic peptide
NRLES

SEQ ID NO: 3663 - protein, 5 aa, Artificial Sequence
  Description of Artificial Sequence: Synthetic peptide
NRLGG

SEQ ID NO: 3664 - protein, 5 aa, Artificial Sequence
  Description of Artificial Sequence: Synthetic peptide
NTLPK

SEQ ID NO: 3665 - protein, 5 aa, Artificial Sequence
  Description of Artificial Sequence: Synthetic peptide
PGLHG

SEQ ID NO: 3666 - protein, 5 aa, Artificial Sequence
  Description of Artificial Sequence: Synthetic peptide
PGLRA

SEQ ID NO: 3667 - protein, 5 aa, Artificial Sequence
  Description of Artificial Sequence: Synthetic peptide
PHFTK

SEQ ID NO: 3668 - protein, 5 aa, Artificial Sequence
  Description of Artificial Sequence: Synthetic peptide
PILLQ

SEQ ID NO: 3669 - protein, 5 aa, Artificial Sequence
  Description of Artificial Sequence: Synthetic peptide
PKLGL

SEQ ID NO: 3670 - protein, 5 aa, Artificial Sequence
  Description of Artificial Sequence: Synthetic peptide
PLLKS

SEQ ID NO: 3671 - protein, 5 aa, Artificial Sequence
  Description of Artificial Sequence: Synthetic peptide
PQLTG

SEQ ID NO: 3672 - protein, 5 aa, Artificial Sequence
  Description of Artificial Sequence: Synthetic peptide
PREAM

SEQ ID NO: 3673 - protein, 5 aa, Artificial Sequence
  Description of Artificial Sequence: Synthetic peptide
PTLQR

SEQ ID NO: 3674 - protein, 5 aa, Artificial Sequence
  Description of Artificial Sequence: Synthetic peptide
QELGR

SEQ ID NO: 3675 - protein, 5 aa, Artificial Sequence
  Description of Artificial Sequence: Synthetic peptide
QGLPV

SEQ ID NO: 3676 - protein, 5 aa, Artificial Sequence
  Description of Artificial Sequence: Synthetic peptide
QHLKK

SEQ ID NO: 3677 - protein, 5 aa, Artificial Sequence
  Description of Artificial Sequence: Synthetic peptide
QHLQR

SEQ ID NO: 3678 - protein, 4 aa, Artificial Sequence
  Description of Artificial Sequence: Synthetic peptide
QHLR

SEQ ID NO: 3679 - protein, 5 aa, Artificial Sequence
  Description of Artificial Sequence: Synthetic peptide
QHLRI

SEQ ID NO: 3680 - protein, 5 aa, Artificial Sequence
  Description of Artificial Sequence: Synthetic peptide
QHLRL

SEQ ID NO: 3681 - protein, 5 aa, Artificial Sequence
  Description of Artificial Sequence: Synthetic peptide
QHLTK

SEQ ID NO: 3682 - protein, 5 aa, Artificial Sequence
  Description of Artificial Sequence: Synthetic peptide
QILLH

SEQ ID NO: 3683 - protein, 5 aa, Artificial Sequence
  Description of Artificial Sequence: Synthetic peptide
QKLRI

SEQ ID NO: 3684 - protein, 5 aa, Artificial Sequence
  Description of Artificial Sequence: Synthetic peptide
QNLHK

SEQ ID NO: 3685 - protein, 5 aa, Artificial Sequence
  Description of Artificial Sequence: Synthetic peptide
QPLIK

SEQ ID NO: 3686 - protein, 5 aa, Artificial Sequence
  Description of Artificial Sequence: Synthetic peptide
QQVTA

SEQ ID NO: 3687 - protein, 5 aa, Artificial Sequence
  Description of Artificial Sequence: Synthetic peptide
QTLAE

SEQ ID NO: 3688 - protein, 5 aa, Artificial Sequence
  Description of Artificial Sequence: Synthetic peptide
QVTLA

SEQ ID NO: 3689 - protein, 5 aa, Artificial Sequence
  Description of Artificial Sequence: Synthetic peptide
RALSA

SEQ ID NO: 3690 - protein, 5 aa, Artificial Sequence
  Description of Artificial Sequence: Synthetic peptide
RGLGA

SEQ ID NO: 3691 - protein, 5 aa, Artificial Sequence
  Description of Artificial Sequence: Synthetic peptide
RGLTA

SEQ ID NO: 3692 - protein, 5 aa, Artificial Sequence
  Description of Artificial Sequence: Synthetic peptide
RGLVV

SEQ ID NO: 3693 - protein, 5 aa, Artificial Sequence
  Description of Artificial Sequence: Synthetic peptide
RHLRA

SEQ ID NO: 3694 - protein, 5 aa, Artificial Sequence
  Description of Artificial Sequence: Synthetic peptide
RHLRE

SEQ ID NO: 3695 - protein, 5 aa, Artificial Sequence
  Description of Artificial Sequence: Synthetic peptide
RHLRM

SEQ ID NO: 3696 - protein, 5 aa, Artificial Sequence
  Description of Artificial Sequence: Synthetic peptide
RHLRR

SEQ ID NO: 3697 - protein, 5 aa, Artificial Sequence
  Description of Artificial Sequence: Synthetic peptide
RILPR

SEQ ID NO: 3698 - protein, 5 aa, Artificial Sequence
  Description of Artificial Sequence: Synthetic peptide
RKLIV

SEQ ID NO: 3699 - protein, 5 aa, Artificial Sequence
  Description of Artificial Sequence: Synthetic peptide
RKLKL

SEQ ID NO: 3700 - protein, 5 aa, Artificial Sequence
  Description of Artificial Sequence: Synthetic peptide
RLLGA

SEQ ID NO: 3701 - protein, 5 aa, Artificial Sequence
  Description of Artificial Sequence: Synthetic peptide
RLLMP

SEQ ID NO: 3702 - protein, 5 aa, Artificial Sequence
  Description of Artificial Sequence: Synthetic peptide
RLLRR

SEQ ID NO: 3703 - protein, 5 aa, Artificial Sequence
  Description of Artificial Sequence: Synthetic peptide
RMLVP

SEQ ID NO: 3704 - protein, 5 aa, Artificial Sequence
  Description of Artificial Sequence: Synthetic peptide
RRLEG

SEQ ID NO: 3705 - protein, 5 aa, Artificial Sequence
  Description of Artificial Sequence: Synthetic peptide
RRLVN

SEQ ID NO: 3706 - protein, 5 aa, Artificial Sequence
  Description of Artificial Sequence: Synthetic peptide
RTLML

SEQ ID NO: 3707 - protein, 5 aa, Artificial Sequence
  Description of Artificial Sequence: Synthetic peptide
RTLTQ

SEQ ID NO: 3708 - protein, 5 aa, Artificial Sequence
  Description of Artificial Sequence: Synthetic peptide
SDLHV

SEQ ID NO: 3709 - protein, 5 aa, Artificial Sequence
  Description of Artificial Sequence: Synthetic peptide
SDLRK

SEQ ID NO: 3710 - protein, 5 aa, Artificial Sequence
  Description of Artificial Sequence: Synthetic peptide
SGLLV

SEQ ID NO: 3711 - protein, 5 aa, Artificial Sequence
  Description of Artificial Sequence: Synthetic peptide
SHLKM

SEQ ID NO: 3712 - protein, 5 aa, Artificial Sequence
  Description of Artificial Sequence: Synthetic peptide
SHLRA

SEQ ID NO: 3713 - protein, 5 aa, Artificial Sequence
  Description of Artificial Sequence: Synthetic peptide
SHLRE

SEQ ID NO: 3714 - protein, 5 aa, Artificial Sequence
  Description of Artificial Sequence: Synthetic peptide
SHLRG

SEQ ID NO: 3715 - protein, 5 aa, Artificial Sequence
  Description of Artificial Sequence: Synthetic peptide
SHLTK

SEQ ID NO: 3716 - protein, 5 aa, Artificial Sequence
  Description of Artificial Sequence: Synthetic peptide
SHLTM

SEQ ID NO: 3717 - protein, 4 aa, Artificial Sequence
  Description of Artificial Sequence: Synthetic peptide
SHLV

SEQ ID NO: 3718 - protein, 5 aa, Artificial Sequence
  Description of Artificial Sequence: Synthetic peptide
SHLVK

SEQ ID NO: 3719 - protein, 5 aa, Artificial Sequence
  Description of Artificial Sequence: Synthetic peptide
SKIRL

SEQ ID NO: 3720 - protein, 5 aa, Artificial Sequence
  Description of Artificial Sequence: Synthetic peptide
SKLEG

SEQ ID NO: 3721 - protein, 5 aa, Artificial Sequence
  Description of Artificial Sequence: Synthetic peptide
SKLGA

SEQ ID NO: 3722 - protein, 5 aa, Artificial Sequence
  Description of Artificial Sequence: Synthetic peptide
SKLKG

SEQ ID NO: 3723 - protein, 5 aa, Artificial Sequence
  Description of Artificial Sequence: Synthetic peptide
SKLRN

SEQ ID NO: 3724 - protein, 5 aa, Artificial Sequence
  Description of Artificial Sequence: Synthetic peptide
SKLRR

SEQ ID NO: 3725 - protein, 5 aa, Artificial Sequence
  Description of Artificial Sequence: Synthetic peptide
SLLEE

SEQ ID NO: 3726 - protein, 5 aa, Artificial Sequence
  Description of Artificial Sequence: Synthetic peptide
SLLGT

SEQ ID NO: 3727 - protein, 5 aa, Artificial Sequence
  Description of Artificial Sequence: Synthetic peptide
SLLNG

SEQ ID NO: 3728 - protein, 5 aa, Artificial Sequence
  Description of Artificial Sequence: Synthetic peptide
SQLLE

SEQ ID NO: 3729 - protein, 5 aa, Artificial Sequence
  Description of Artificial Sequence: Synthetic peptide
SRLMA

SEQ ID NO: 3730 - protein, 5 aa, Artificial Sequence
  Description of Artificial Sequence: Synthetic peptide
STLLM

SEQ ID NO: 3731 - protein, 5 aa, Artificial Sequence
  Description of Artificial Sequence: Synthetic peptide
STLVG

SEQ ID NO: 3732 - protein, 5 aa, Artificial Sequence
  Description of Artificial Sequence: Synthetic peptide
TALRG

SEQ ID NO: 3733 - protein, 5 aa, Artificial Sequence
  Description of Artificial Sequence: Synthetic peptide
TGLGL

SEQ ID NO: 3734 - protein, 5 aa, Artificial Sequence
  Description of Artificial Sequence: Synthetic peptide
TGLLK

SEQ ID NO: 3735 - protein, 5 aa, Artificial Sequence
  Description of Artificial Sequence: Synthetic peptide
TGLVD

SEQ ID NO: 3736 - protein, 5 aa, Artificial Sequence
  Description of Artificial Sequence: Synthetic peptide
THFRT

SEQ ID NO: 3737 - protein, 4 aa, Artificial Sequence
  Description of Artificial Sequence: Synthetic peptide
THIR

SEQ ID NO: 3738 - protein, 5 aa, Artificial Sequence
  Description of Artificial Sequence: Synthetic peptide
THLAR

SEQ ID NO: 3739 - protein, 5 aa, Artificial Sequence
  Description of Artificial Sequence: Synthetic peptide
THLLK

SEQ ID NO: 3740 - protein, 5 aa, Artificial Sequence
  Description of Artificial Sequence: Synthetic peptide
THLMK

SEQ ID NO: 3741 - protein, 5 aa, Artificial Sequence
  Description of Artificial Sequence: Synthetic peptide
THLVK

SEQ ID NO: 3742 - protein, 4 aa, Artificial Sequence
  Description of Artificial Sequence: Synthetic peptide
THMK

SEQ ID NO: 3743 - protein, 5 aa, Artificial Sequence
  Description of Artificial Sequence: Synthetic peptide
THVKK

SEQ ID NO: 3744 - protein, 5 aa, Artificial Sequence
  Description of Artificial Sequence: Synthetic peptide
TKLKM

SEQ ID NO: 3745 - protein, 5 aa, Artificial Sequence
  Description of Artificial Sequence: Synthetic peptide
TKLKR

SEQ ID NO: 3746 - protein, 5 aa, Artificial Sequence
  Description of Artificial Sequence: Synthetic peptide
TKLNM

SEQ ID NO: 3747 - protein, 5 aa, Artificial Sequence
  Description of Artificial Sequence: Synthetic peptide
TKLRK

SEQ ID NO: 3748 - protein, 5 aa, Artificial Sequence
  Description of Artificial Sequence: Synthetic peptide
TKLRP

SEQ ID NO: 3749 - protein, 4 aa, Artificial Sequence
  Description of Artificial Sequence: Synthetic peptide
TKLS

SEQ ID NO: 3750 - protein, 5 aa, Artificial Sequence
  Description of Artificial Sequence: Synthetic peptide
TKLTI

SEQ ID NO: 3751 - protein, 5 aa, Artificial Sequence
  Description of Artificial Sequence: Synthetic peptide
TMLGG

SEQ ID NO: 3752 - protein, 5 aa, Artificial Sequence
  Description of Artificial Sequence: Synthetic peptide
TMLKL

SEQ ID NO: 3753 - protein, 5 aa, Artificial Sequence
  Description of Artificial Sequence: Synthetic peptide
TMLPG

SEQ ID NO: 3754 - protein, 5 aa, Artificial Sequence
  Description of Artificial Sequence: Synthetic peptide
TPLKR

SEQ ID NO: 3755 - protein, 5 aa, Artificial Sequence
  Description of Artificial Sequence: Synthetic peptide
TPLRA

SEQ ID NO: 3756 - protein, 5 aa, Artificial Sequence
  Description of Artificial Sequence: Synthetic peptide
TQLKK

SEQ ID NO: 3757 - protein, 5 aa, Artificial Sequence
  Description of Artificial Sequence: Synthetic peptide
TQLKL

SEQ ID NO: 3758 - protein, 4 aa, Artificial Sequence
  Description of Artificial Sequence: Synthetic peptide
TRRL

SEQ ID NO: 3759 - protein, 5 aa, Artificial Sequence
  Description of Artificial Sequence: Synthetic peptide
TRLKL

SEQ ID NO: 3760 - protein, 5 aa, Artificial Sequence
  Description of Artificial Sequence: Synthetic peptide
TTLGI

SEQ ID NO: 3761 - protein, 5 aa, Artificial Sequence
  Description of Artificial Sequence: Synthetic peptide
TYLKK

SEQ ID NO: 3762 - protein, 5 aa, Artificial Sequence
  Description of Artificial Sequence: Synthetic peptide
VELDP

SEQ ID NO: 3763 - protein, 5 aa, Artificial Sequence
  Description of Artificial Sequence: Synthetic peptide
VELVN

SEQ ID NO: 3764 - protein, 5 aa, Artificial Sequence
  Description of Artificial Sequence: Synthetic peptide
VKLQQ

SEQ ID NO: 3765 - protein, 5 aa, Artificial Sequence
  Description of Artificial Sequence: Synthetic peptide
VKLRL

SEQ ID NO: 3766 - protein, 5 aa, Artificial Sequence
  Description of Artificial Sequence: Synthetic peptide
VKLRN

SEQ ID NO: 3767 - protein, 5 aa, Artificial Sequence
  Description of Artificial Sequence: Synthetic peptide
VKLRV

SEQ ID NO: 3768 - protein, 5 aa, Artificial Sequence
  Description of Artificial Sequence: Synthetic peptide
VLLKS

SEQ ID NO: 3769 - protein, 5 aa, Artificial Sequence
  Description of Artificial Sequence: Synthetic peptide
VLLQM

SEQ ID NO: 3770 - protein, 5 aa, Artificial Sequence
  Description of Artificial Sequence: Synthetic peptide
VMLKD

SEQ ID NO: 3771 - protein, 5 aa, Artificial Sequence
  Description of Artificial Sequence: Synthetic peptide
VMLMG

SEQ ID NO: 3772 - protein, 5 aa, Artificial Sequence
  Description of Artificial Sequence: Synthetic peptide
VPLAL

SEQ ID NO: 3773 - protein, 5 aa, Artificial Sequence
  Description of Artificial Sequence: Synthetic peptide
VPLER

SEQ ID NO: 3774 - protein, 5 aa, Artificial Sequence
  Description of Artificial Sequence: Synthetic peptide
VPLNT

SEQ ID NO: 3775 - protein, 5 aa, Artificial Sequence
  Description of Artificial Sequence: Synthetic peptide
VPLSS

SEQ ID NO: 3776 - protein, 5 aa, Artificial Sequence
  Description of Artificial Sequence: Synthetic peptide
VPLVP

SEQ ID NO: 3777 - protein, 5 aa, Artificial Sequence
  Description of Artificial Sequence: Synthetic peptide
VRLEE

SEQ ID NO: 3778 - protein, 5 aa, Artificial Sequence
  Description of Artificial Sequence: Synthetic peptide
VRLQA

SEQ ID NO: 3779 - protein, 4 aa, Artificial Sequence
  Description of Artificial Sequence: Synthetic peptide
VVTA

SEQ ID NO: 3780 - protein, 5 aa, Artificial Sequence
  Description of Artificial Sequence: Synthetic peptide
WHLKK

SEQ ID NO: 3781 - protein, 5 aa, Artificial Sequence
  Description of Artificial Sequence: Synthetic peptide
VALGS

SEQ ID NO: 3782 - protein, 5 aa, Artificial Sequence
  Description of Artificial Sequence: Synthetic peptide
AKLVV

SEQ ID NO: 3783 - protein, 5 aa, Artificial Sequence
  Description of Artificial Sequence: Synthetic peptide
TKLRA

SEQ ID NO: 3784 - protein, 5 aa, Artificial Sequence
  Description of Artificial Sequence: Synthetic peptide
LGLRG

SEQ ID NO: 3785 - protein, 5 aa, Artificial Sequence
  Description of Artificial Sequence: Synthetic peptide
TKLKA

SEQ ID NO: 3786 - protein, 5 aa, Artificial Sequence
  Description of Artificial Sequence: Synthetic peptide
PNLAV

SEQ ID NO: 3787 - protein, 5 aa, Artificial Sequence
  Description of Artificial Sequence: Synthetic peptide
GGLEV

SEQ ID NO: 3788 - protein, 5 aa, Artificial Sequence
  Description of Artificial Sequence: Synthetic peptide
PREAI

SEQ ID NO: 3789 - protein, 5 aa, Artificial Sequence
  Description of Artificial Sequence: Synthetic peptide
TKLKG

SEQ ID NO: 3790 - protein, 5 aa, Artificial Sequence
  Description of Artificial Sequence: Synthetic peptide
TKLIV

SEQ ID NO: 3791 - protein, 5 aa, Artificial Sequence
  Description of Artificial Sequence: Synthetic peptide
WILRA

SEQ ID NO: 3792 - protein, 4 aa, Artificial Sequence
  Description of Artificial Sequence: Synthetic peptide
AKRG

SEQ ID NO: 3793 - protein, 4 aa, Artificial Sequence
  Description of Artificial Sequence: Synthetic peptide
EKKV

SEQ ID NO: 3794 - protein, 4 aa, Artificial Sequence
  Description of Artificial Sequence: Synthetic peptide
TKRG

SEQ ID NO: 3795 - protein, 5 aa, Artificial Sequence
  Description of Artificial Sequence: Synthetic peptide
TKLRT

SEQ ID NO: 3796 - protein, 5 aa, Artificial Sequence
  Description of Artificial Sequence: Synthetic peptide
AKLRE

SEQ ID NO: 3797 - protein, 5 aa, Artificial Sequence
  Description of Artificial Sequence: Synthetic peptide
TKLRG

SEQ ID NO: 3798 - protein, 5 aa, Artificial Sequence
  Description of Artificial Sequence: Synthetic peptide
EKLRV

SEQ ID NO: 3799 - protein, 4 aa, Artificial Sequence
  Description of Artificial Sequence: Synthetic peptide
RALW

SEQ ID NO: 3800 - protein, 5 aa, Artificial Sequence
  Description of Artificial Sequence: Synthetic peptide
SKLVV

SEQ ID NO: 3801 - protein, 5 aa, Artificial Sequence
  Description of Artificial Sequence: Synthetic peptide
TKLKE

SEQ ID NO: 3802 - protein, 5 aa, Artificial Sequence
  Description of Artificial Sequence: Synthetic peptide
TKLNV

SEQ ID NO: 3803 - protein, 11 aa, Artificial Sequence
  Description of Artificial Sequence: Synthetic peptide
KDALQYESECG

SEQ ID NO: 3804 - protein, 5 aa, Artificial Sequence
  Description of Artificial Sequence: Synthetic peptide
LSLVD

SEQ ID NO: 3805 - protein, 5 aa, Artificial Sequence
  Description of Artificial Sequence: Synthetic peptide
QKLKV

SEQ ID NO: 3806 - protein, 5 aa, Artificial Sequence
  Description of Artificial Sequence: Synthetic peptide
RELKE

SEQ ID NO: 3807 - protein, 5 aa, Artificial Sequence
  Description of Artificial Sequence: Synthetic peptide
RILGS

SEQ ID NO: 3808 - protein, 5 aa, Artificial Sequence
  Description of Artificial Sequence: Synthetic peptide
TKIRV

SEQ ID NO: 3809 - protein, 5 aa, Artificial Sequence
  Description of Artificial Sequence: Synthetic peptide
TKLRM

SEQ ID NO: 3810 - protein, 5 aa, Artificial Sequence
  Description of Artificial Sequence: Synthetic peptide
TKLVV

SEQ ID NO: 3811 - protein, 5 aa, Artificial Sequence
  Description of Artificial Sequence: Synthetic peptide
TKVRV

SEQ ID NO: 3812 - protein, 6 aa, Artificial Sequence
  Description of Artificial Sequence: Synthetic peptide
TRSHSR

SEQ ID NO: 3813 - protein, 5 aa, Artificial Sequence
  Description of Artificial Sequence: Synthetic peptide
AKLRD

SEQ ID NO: 3814 - protein, 5 aa, Artificial Sequence
  Description of Artificial Sequence: Synthetic peptide
GGLKG

SEQ ID NO: 3815 - protein, 5 aa, Artificial Sequence
  Description of Artificial Sequence: Synthetic peptide
GKLIV

SEQ ID NO: 3816 - protein, 5 aa, Artificial Sequence
  Description of Artificial Sequence: Synthetic peptide
GKLKG

SEQ ID NO: 3817 - protein, 5 aa, Artificial Sequence
  Description of Artificial Sequence: Synthetic peptide
KKLHW

SEQ ID NO: 3818 - protein, 4 aa, Artificial Sequence
  Description of Artificial Sequence: Synthetic peptide
RTLS

SEQ ID NO: 3819 - protein, 5 aa, Artificial Sequence
  Description of Artificial Sequence: Synthetic peptide
SKLRA

SEQ ID NO: 3820 - protein, 5 aa, Artificial Sequence
  Description of Artificial Sequence: Synthetic peptide
SKVRV

SEQ ID NO: 3821 - protein, 4 aa, Artificial Sequence
  Description of Artificial Sequence: Synthetic peptide
TKSV

SEQ ID NO: 3822 - protein, 5 aa, Artificial Sequence
  Description of Artificial Sequence: Synthetic peptide
TKLAV

SEQ ID NO: 3823 - protein, 5 aa, Artificial Sequence
  Description of Artificial Sequence: Synthetic peptide
TKLRE

SEQ ID NO: 3824 - protein, 5 aa, Artificial Sequence
  Description of Artificial Sequence: Synthetic peptide
TKSRV

SEQ ID NO: 3825 - protein, 5 aa, Artificial Sequence
  Description of Artificial Sequence: Synthetic peptide
TKVKV

SEQ ID NO: 3826 - protein, 5 aa, Artificial Sequence
  Description of Artificial Sequence: Synthetic peptide
VMLMM

SEQ ID NO: 3827 - protein, 5 aa, Artificial Sequence
  Description of Artificial Sequence: Synthetic peptide
AILQV

SEQ ID NO: 3828 - protein, 5 aa, Artificial Sequence
  Description of Artificial Sequence: Synthetic peptide
AKLMV

SEQ ID NO: 3829 - protein, 5 aa, Artificial Sequence
  Description of Artificial Sequence: Synthetic peptide
AKLSV

SEQ ID NO: 3830 - protein, 5 aa, Artificial Sequence
  Description of Artificial Sequence: Synthetic peptide
AKVKV

SEQ ID NO: 3831 - protein, 5 aa, Artificial Sequence
  Description of Artificial Sequence: Synthetic peptide
ETLMH

SEQ ID NO: 3832 - protein, 5 aa, Artificial Sequence
  Description of Artificial Sequence: Synthetic peptide
GKSKV

SEQ ID NO: 3833 - protein, 5 aa, Artificial Sequence
  Description of Artificial Sequence: Synthetic peptide
IKLRV

SEQ ID NO: 3834 - protein, 5 aa, Artificial Sequence
  Description of Artificial Sequence: Synthetic peptide
KALHT

SEQ ID NO: 3835 - protein, 5 aa, Artificial Sequence
  Description of Artificial Sequence: Synthetic peptide
KGLMM

SEQ ID NO: 3836 - protein, 5 aa, Artificial Sequence
  Description of Artificial Sequence: Synthetic peptide
MELAE

SEQ ID NO: 3837 - protein, 5 aa, Artificial Sequence
  Description of Artificial Sequence: Synthetic peptide
NKLKV

SEQ ID NO: 3838 - protein, 5 aa, Artificial Sequence
  Description of Artificial Sequence: Synthetic peptide
PRLLA

SEQ ID NO: 3839 - protein, 5 aa, Artificial Sequence
  Description of Artificial Sequence: Synthetic peptide
PRLSR

SEQ ID NO: 3840 - protein, 5 aa, Artificial Sequence
  Description of Artificial Sequence: Synthetic peptide
QGLEA

SEQ ID NO: 3841 - protein, 5 aa, Artificial Sequence
  Description of Artificial Sequence: Synthetic peptide
SKLRE

SEQ ID NO: 3842 - protein, 5 aa, Artificial Sequence
  Description of Artificial Sequence: Synthetic peptide
SKLRG

SEQ ID NO: 3843 - protein, 5 aa, Artificial Sequence
  Description of Artificial Sequence: Synthetic peptide
TKIKV

SEQ ID NO: 3844 - protein, 5 aa, Artificial Sequence
  Description of Artificial Sequence: Synthetic peptide
TKLRD

SEQ ID NO: 3845 - protein, 5 aa, Artificial Sequence
  Description of Artificial Sequence: Synthetic peptide
TKLSV

SEQ ID NO: 3846 - protein, 5 aa, Artificial Sequence
  Description of Artificial Sequence: Synthetic peptide
AELKA

SEQ ID NO: 3847 - protein, 5 aa, Artificial Sequence
  Description of Artificial Sequence: Synthetic peptide
AELKV

SEQ ID NO: 3848 - protein, 5 aa, Artificial Sequence
  Description of Artificial Sequence: Synthetic peptide
AGLKH

SEQ ID NO: 3849 - protein, 5 aa, Artificial Sequence
  Description of Artificial Sequence: Synthetic peptide
AKIRE

SEQ ID NO: 3850 - protein, 5 aa, Artificial Sequence
  Description of Artificial Sequence: Synthetic peptide
AKLAV

SEQ ID NO: 3851 - protein, 5 aa, Artificial Sequence
  Description of Artificial Sequence: Synthetic peptide
AKLGV

SEQ ID NO: 3852 - protein, 5 aa, Artificial Sequence
  Description of Artificial Sequence: Synthetic peptide
AKLMI

SEQ ID NO: 3853 - protein, 5 aa, Artificial Sequence
  Description of Artificial Sequence: Synthetic peptide
AKLNV

SEQ ID NO: 3854 - protein, 5 aa, Artificial Sequence
  Description of Artificial Sequence: Synthetic peptide
AKLRF

SEQ ID NO: 3855 - protein, 5 aa, Artificial Sequence
  Description of Artificial Sequence: Synthetic peptide
AKLRN

SEQ ID NO: 3856 - protein, 5 aa, Artificial Sequence
  Description of Artificial Sequence: Synthetic peptide
AKLWV

SEQ ID NO: 3857 - protein, 5 aa, Artificial Sequence
  Description of Artificial Sequence: Synthetic peptide
AKRRV

SEQ ID NO: 3858 - protein, 5 aa, Artificial Sequence
  Description of Artificial Sequence: Synthetic peptide
AKSKV

SEQ ID NO: 3859 - protein, 5 aa, Artificial Sequence
  Description of Artificial Sequence: Synthetic peptide
AKVRG

SEQ ID NO: 3860 - protein, 5 aa, Artificial Sequence
  Description of Artificial Sequence: Synthetic peptide
ALLKV

SEQ ID NO: 3861 - protein, 5 aa, Artificial Sequence
  Description of Artificial Sequence: Synthetic peptide
AMLKV

SEQ ID NO: 3862 - protein, 5 aa, Artificial Sequence
  Description of Artificial Sequence: Synthetic peptide
AQLKV

SEQ ID NO: 3863 - protein, 5 aa, Artificial Sequence
  Description of Artificial Sequence: Synthetic peptide
AQLRV

SEQ ID NO: 3864 - protein, 5 aa, Artificial Sequence
  Description of Artificial Sequence: Synthetic peptide
ARLRI

SEQ ID NO: 3865 - protein, 5 aa, Artificial Sequence
  Description of Artificial Sequence: Synthetic peptide
ATLQV

SEQ ID NO: 3866 - protein, 5 aa, Artificial Sequence
  Description of Artificial Sequence: Synthetic peptide
AVLKV

SEQ ID NO: 3867 - protein, 5 aa, Artificial Sequence
  Description of Artificial Sequence: Synthetic peptide
AYPRE

SEQ ID NO: 3868 - protein, 5 aa, Artificial Sequence
  Description of Artificial Sequence: Synthetic peptide
CGLHW

SEQ ID NO: 3869 - protein, 5 aa, Artificial Sequence
  Description of Artificial Sequence: Synthetic peptide
CKLRV

SEQ ID NO: 3870 - protein, 5 aa, Artificial Sequence
  Description of Artificial Sequence: Synthetic peptide
DGLTG

SEQ ID NO: 3871 - protein, 5 aa, Artificial Sequence
  Description of Artificial Sequence: Synthetic peptide
DHLKR

SEQ ID NO: 3872 - protein, 5 aa, Artificial Sequence
  Description of Artificial Sequence: Synthetic peptide
DRLTI

SEQ ID NO: 3873 - protein, 5 aa, Artificial Sequence
  Description of Artificial Sequence: Synthetic peptide
DVLKG

SEQ ID NO: 3874 - protein, 5 aa, Artificial Sequence
  Description of Artificial Sequence: Synthetic peptide
DVLRG

SEQ ID NO: 3875 - protein, 5 aa, Artificial Sequence
  Description of Artificial Sequence: Synthetic peptide
EALVH

SEQ ID NO: 3876 - protein, 5 aa, Artificial Sequence
  Description of Artificial Sequence: Synthetic peptide
EQLMT

SEQ ID NO: 3877 - protein, 5 aa, Artificial Sequence
  Description of Artificial Sequence: Synthetic peptide
EVLAA

SEQ ID NO: 3878 - protein, 5 aa, Artificial Sequence
  Description of Artificial Sequence: Synthetic peptide
GGLKD

SEQ ID NO: 3879 - protein, 5 aa, Artificial Sequence
  Description of Artificial Sequence: Synthetic peptide
GGLKI

SEQ ID NO: 3880 - protein, 5 aa, Artificial Sequence
  Description of Artificial Sequence: Synthetic peptide
GILRM

SEQ ID NO: 3881 - protein, 4 aa, Artificial Sequence
  Description of Artificial Sequence: Synthetic peptide
GKRG

SEQ ID NO: 3882 - protein, 5 aa, Artificial Sequence
  Description of Artificial Sequence: Synthetic peptide
GKLML

SEQ ID NO: 3883 - protein, 5 aa, Artificial Sequence
  Description of Artificial Sequence: Synthetic peptide
GKLQV

SEQ ID NO: 3884 - protein, 5 aa, Artificial Sequence
  Description of Artificial Sequence: Synthetic peptide
GKLRQ

SEQ ID NO: 3885 - protein, 5 aa, Artificial Sequence
  Description of Artificial Sequence: Synthetic peptide
GKLRT

SEQ ID NO: 3886 - protein, 5 aa, Artificial Sequence
  Description of Artificial Sequence: Synthetic peptide
GPLGQ

SEQ ID NO: 3887 - protein, 5 aa, Artificial Sequence
  Description of Artificial Sequence: Synthetic peptide
GPLMG

SEQ ID NO: 3888 - protein, 5 aa, Artificial Sequence
  Description of Artificial Sequence: Synthetic peptide
GQLKA

SEQ ID NO: 3889 - protein, 5 aa, Artificial Sequence
  Description of Artificial Sequence: Synthetic peptide
GRLAV

SEQ ID NO: 3890 - protein, 5 aa, Artificial Sequence
  Description of Artificial Sequence: Synthetic peptide
GRLNA

SEQ ID NO: 3891 - protein, 5 aa, Artificial Sequence
  Description of Artificial Sequence: Synthetic peptide
HPLTV

SEQ ID NO: 3892 - protein, 5 aa, Artificial Sequence
  Description of Artificial Sequence: Synthetic peptide
HRLTR

SEQ ID NO: 3893 - protein, 5 aa, Artificial Sequence
  Description of Artificial Sequence: Synthetic peptide
IKLKV

SEQ ID NO: 3894 - protein, 5 aa, Artificial Sequence
  Description of Artificial Sequence: Synthetic peptide
IMLKS

SEQ ID NO: 3895 - protein, 5 aa, Artificial Sequence
  Description of Artificial Sequence: Synthetic peptide
IQSGE

SEQ ID NO: 3896 - protein, 6 aa, Artificial Sequence
  Description of Artificial Sequence: Synthetic peptide
IQVTLA

SEQ ID NO: 3897 - protein, 5 aa, Artificial Sequence
  Description of Artificial Sequence: Synthetic peptide
IRLAL

SEQ ID NO: 3898 - protein, 5 aa, Artificial Sequence
  Description of Artificial Sequence: Synthetic peptide
KALRG

SEQ ID NO: 3899 - protein, 5 aa, Artificial Sequence
  Description of Artificial Sequence: Synthetic peptide
KKLRE

SEQ ID NO: 3900 - protein, 5 aa, Artificial Sequence
  Description of Artificial Sequence: Synthetic peptide
KKLVR

SEQ ID NO: 3901 - protein, 5 aa, Artificial Sequence
  Description of Artificial Sequence: Synthetic peptide
LSLDG

SEQ ID NO: 3902 - protein, 5 aa, Artificial Sequence
  Description of Artificial Sequence: Synthetic peptide
MELDR

SEQ ID NO: 3903 - protein, 5 aa, Artificial Sequence
  Description of Artificial Sequence: Synthetic peptide
MKLQA

SEQ ID NO: 3904 - protein, 5 aa, Artificial Sequence
  Description of Artificial Sequence: Synthetic peptide
MKLRV

SEQ ID NO: 3905 - protein, 5 aa, Artificial Sequence
  Description of Artificial Sequence: Synthetic peptide
MPLLA

SEQ ID NO: 3906 - protein, 15 aa, Artificial Sequence
  Description of Artificial Sequence: Synthetic peptide
MRLARHIRSHTGERP

SEQ ID NO: 3907 - protein, 5 aa, Artificial Sequence
  Description of Artificial Sequence: Synthetic peptide
MSLVN

SEQ ID NO: 3908 - protein, 5 aa, Artificial Sequence
  Description of Artificial Sequence: Synthetic peptide
MVLQE

SEQ ID NO: 3909 - protein, 5 aa, Artificial Sequence
  Description of Artificial Sequence: Synthetic peptide
MVLVG

SEQ ID NO: 3910 - protein, 12 aa, Artificial Sequence
  Description of Artificial Sequence: Synthetic peptide
NDALEYESECGP

SEQ ID NO: 3911 - protein, 12 aa, Artificial Sequence
  Description of Artificial Sequence: Synthetic peptide
NDALQYESVCVP

SEQ ID NO: 3912 - protein, 5 aa, Artificial Sequence
  Description of Artificial Sequence: Synthetic peptide
NGLVV

SEQ ID NO: 3913 - protein, 4 aa, Artificial Sequence
  Description of Artificial Sequence: Synthetic peptide
NKNV

SEQ ID NO: 3914 - protein, 5 aa, Artificial Sequence
  Description of Artificial Sequence: Synthetic peptide
NKLRV

SEQ ID NO: 3915 - protein, 5 aa, Artificial Sequence
  Description of Artificial Sequence: Synthetic peptide
NVLGG

SEQ ID NO: 3916 - protein, 5 aa, Artificial Sequence
  Description of Artificial Sequence: Synthetic peptide
PGLAA

SEQ ID NO: 3917 - protein, 5 aa, Artificial Sequence
  Description of Artificial Sequence: Synthetic peptide
PKLRA

SEQ ID NO: 3918 - protein, 5 aa, Artificial Sequence
  Description of Artificial Sequence: Synthetic peptide
PNLAG

SEQ ID NO: 3919 - protein, 4 aa, Artificial Sequence
  Description of Artificial Sequence: Synthetic peptide
PNYW

SEQ ID NO: 3920 - protein, 5 aa, Artificial Sequence
  Description of Artificial Sequence: Synthetic peptide
PVLDH

SEQ ID NO: 3921 - protein, 5 aa, Artificial Sequence
  Description of Artificial Sequence: Synthetic peptide
QALTN

SEQ ID NO: 3922 - protein, 5 aa, Artificial Sequence
  Description of Artificial Sequence: Synthetic peptide
QVLRK

SEQ ID NO: 3923 - protein, 5 aa, Artificial Sequence
  Description of Artificial Sequence: Synthetic peptide
RELVR

SEQ ID NO: 3924 - protein, 5 aa, Artificial Sequence
  Description of Artificial Sequence: Synthetic peptide
RGLDM

SEQ ID NO: 3925 - protein, 5 aa, Artificial Sequence
  Description of Artificial Sequence: Synthetic peptide
RGLDR

SEQ ID NO: 3926 - protein, 5 aa, Artificial Sequence
  Description of Artificial Sequence: Synthetic peptide
RGLVA

SEQ ID NO: 3927 - protein, 5 aa, Artificial Sequence
  Description of Artificial Sequence: Synthetic peptide
RKLKA

SEQ ID NO: 3928 - protein, 5 aa, Artificial Sequence
  Description of Artificial Sequence: Synthetic peptide
RKLKV

SEQ ID NO: 3929 - protein, 5 aa, Artificial Sequence
  Description of Artificial Sequence: Synthetic peptide
RKLRE

SEQ ID NO: 3930 - protein, 5 aa, Artificial Sequence
  Description of Artificial Sequence: Synthetic peptide
RKLRV

SEQ ID NO: 3931 - protein, 5 aa, Artificial Sequence
  Description of Artificial Sequence: Synthetic peptide
RKVRV

SEQ ID NO: 3932 - protein, 5 aa, Artificial Sequence
  Description of Artificial Sequence: Synthetic peptide
RMLQE

SEQ ID NO: 3933 - protein, 5 aa, Artificial Sequence
  Description of Artificial Sequence: Synthetic peptide
RPLEV

SEQ ID NO: 3934 - protein, 5 aa, Artificial Sequence
  Description of Artificial Sequence: Synthetic peptide
SKFKV

SEQ ID NO: 3935 - protein, 5 aa, Artificial Sequence
  Description of Artificial Sequence: Synthetic peptide
SKFRV

SEQ ID NO: 3936 - protein, 5 aa, Artificial Sequence
  Description of Artificial Sequence: Synthetic peptide
SKIRT

SEQ ID NO: 3937 - protein, 5 aa, Artificial Sequence
  Description of Artificial Sequence: Synthetic peptide
SKLKD

SEQ ID NO: 3938 - protein, 5 aa, Artificial Sequence
  Description of Artificial Sequence: Synthetic peptide
SKLKM

SEQ ID NO: 3939 - protein, 5 aa, Artificial Sequence
  Description of Artificial Sequence: Synthetic peptide
SKLQI

SEQ ID NO: 3940 - protein, 5 aa, Artificial Sequence
  Description of Artificial Sequence: Synthetic peptide
SKLSV

SEQ ID NO: 3941 - protein, 5 aa, Artificial Sequence
  Description of Artificial Sequence: Synthetic peptide
SKLTV

SEQ ID NO: 3942 - protein, 5 aa, Artificial Sequence
  Description of Artificial Sequence: Synthetic peptide
SKSRT

SEQ ID NO: 3943 - protein, 5 aa, Artificial Sequence
  Description of Artificial Sequence: Synthetic peptide
SKVKV

SEQ ID NO: 3944 - protein, 5 aa, Artificial Sequence
  Description of Artificial Sequence: Synthetic peptide
SKVRT

SEQ ID NO: 3945 - protein, 5 aa, Artificial Sequence
  Description of Artificial Sequence: Synthetic peptide
SNLKG

SEQ ID NO: 3946 - protein, 5 aa, Artificial Sequence
  Description of Artificial Sequence: Synthetic peptide
SNLTH

SEQ ID NO: 3947 - protein, 5 aa, Artificial Sequence
  Description of Artificial Sequence: Synthetic peptide
TALIS

SEQ ID NO: 3948 - protein, 5 aa, Artificial Sequence
  Description of Artificial Sequence: Synthetic peptide
TELIG

SEQ ID NO: 3949 - protein, 5 aa, Artificial Sequence
  Description of Artificial Sequence: Synthetic peptide
TELKV

SEQ ID NO: 3950 - protein, 5 aa, Artificial Sequence
  Description of Artificial Sequence: Synthetic peptide
TKLHV

SEQ ID NO: 3951 - protein, 5 aa, Artificial Sequence
  Description of Artificial Sequence: Synthetic peptide
TKLKD

SEQ ID NO: 3952 - protein, 5 aa, Artificial Sequence
  Description of Artificial Sequence: Synthetic peptide
TKLKT

SEQ ID NO: 3953 - protein, 5 aa, Artificial Sequence
  Description of Artificial Sequence: Synthetic peptide
TKLMA

SEQ ID NO: 3954 - protein, 5 aa, Artificial Sequence
  Description of Artificial Sequence: Synthetic peptide
TKLQI

SEQ ID NO: 3955 - protein, 4 aa, Artificial Sequence
  Description of Artificial Sequence: Synthetic peptide
TKLR

SEQ ID NO: 3956 - protein, 5 aa, Artificial Sequence
  Description of Artificial Sequence: Synthetic peptide
TKLTV

SEQ ID NO: 3957 - protein, 5 aa, Artificial Sequence
  Description of Artificial Sequence: Synthetic peptide
TKLWV

SEQ ID NO: 3958 - protein, 5 aa, Artificial Sequence
  Description of Artificial Sequence: Synthetic peptide
TKSRD

SEQ ID NO: 3959 - protein, 5 aa, Artificial Sequence
  Description of Artificial Sequence: Synthetic peptide
TMLKV

SEQ ID NO: 3960 - protein, 5 aa, Artificial Sequence
  Description of Artificial Sequence: Synthetic peptide
TMLRV

SEQ ID NO: 3961 - protein, 5 aa, Artificial Sequence
  Description of Artificial Sequence: Synthetic peptide
TRSHS

SEQ ID NO: 3962 - protein, 5 aa, Artificial Sequence
  Description of Artificial Sequence: Synthetic peptide
TTIRV

SEQ ID NO: 3963 - protein, 5 aa, Artificial Sequence
  Description of Artificial Sequence: Synthetic peptide
TTLSA

SEQ ID NO: 3964 - protein, 5 aa, Artificial Sequence
  Description of Artificial Sequence: Synthetic peptide
TTLVP

SEQ ID NO: 3965 - protein, 5 aa, Artificial Sequence
  Description of Artificial Sequence: Synthetic peptide
TVLAP

SEQ ID NO: 3966 - protein, 5 aa, Artificial Sequence
  Description of Artificial Sequence: Synthetic peptide
TVLPM

SEQ ID NO: 3967 - protein, 5 aa, Artificial Sequence
  Description of Artificial Sequence: Synthetic peptide
VALTK

SEQ ID NO: 3968 - protein, 5 aa, Artificial Sequence
  Description of Artificial Sequence: Synthetic peptide
VGLLR

SEQ ID NO: 3969 - protein, 5 aa, Artificial Sequence
  Description of Artificial Sequence: Synthetic peptide
VKLLV

SEQ ID NO: 3970 - protein, 5 aa, Artificial Sequence
  Description of Artificial Sequence: Synthetic peptide
VLLMA

SEQ ID NO: 3971 - protein, 5 aa, Artificial Sequence
  Description of Artificial Sequence: Synthetic peptide
VLLPS

SEQ ID NO: 3972 - protein, 5 aa, Artificial Sequence
  Description of Artificial Sequence: Synthetic peptide
VNLLE

SEQ ID NO: 3973 - protein, 5 aa, Artificial Sequence
  Description of Artificial Sequence: Synthetic peptide
VQLPV

SEQ ID NO: 3974 - protein, 5 aa, Artificial Sequence
  Description of Artificial Sequence: Synthetic peptide
YTHMK

SEQ ID NO: 3975 - protein, 7 aa, Artificial Sequence
  Description of Artificial Sequence: Synthetic peptide
NGRSPVC

SEQ ID NO: 3976 - protein, 5 aa, Artificial Sequence
  Description of Artificial Sequence: Synthetic peptide
AELIR

SEQ ID NO: 3977 - protein, 4 aa, Artificial Sequence
  Description of Artificial Sequence: Synthetic peptide
RGLT

SEQ ID NO: 3978 - protein, 5 aa, Artificial Sequence
  Description of Artificial Sequence: Synthetic peptide
TLLMG

SEQ ID NO: 3979 - protein, 4 aa, Artificial Sequence
  Description of Artificial Sequence: Synthetic peptide
TLPL

SEQ ID NO: 3980 - protein, 4 aa, Artificial Sequence
  Description of Artificial Sequence: Synthetic peptide
MLTS

SEQ ID NO: 3981 - protein, 5 aa, Artificial Sequence
  Description of Artificial Sequence: Synthetic peptide
EMLTS

SEQ ID NO: 3982 - protein, 5 aa, Artificial Sequence
  Description of Artificial Sequence: Synthetic peptide
DALRG

SEQ ID NO: 3983 - protein, 5 aa, Artificial Sequence
  Description of Artificial Sequence: Synthetic peptide
PLLET

SEQ ID NO: 3984 - protein, 4 aa, Artificial Sequence
  Description of Artificial Sequence: Synthetic peptide
PSLM

SEQ ID NO: 3985 - protein, 5 aa, Artificial Sequence
  Description of Artificial Sequence: Synthetic peptide
TLLVG

SEQ ID NO: 3986 - protein, 5 aa, Artificial Sequence
  Description of Artificial Sequence: Synthetic peptide
GPLHI

SEQ ID NO: 3987 - protein, 5 aa, Artificial Sequence
  Description of Artificial Sequence: Synthetic peptide
VELNS

SEQ ID NO: 3988 - protein, 5 aa, Artificial Sequence
  Description of Artificial Sequence: Synthetic peptide
AKLIT

SEQ ID NO: 3989 - protein, 4 aa, Artificial Sequence
  Description of Artificial Sequence: Synthetic peptide
ATRR

SEQ ID NO: 3990 - protein, 5 aa, Artificial Sequence
  Description of Artificial Sequence: Synthetic peptide
SPLLS

SEQ ID NO: 3991 - protein, 5 aa, Artificial Sequence
  Description of Artificial Sequence: Synthetic peptide
DKLRR

SEQ ID NO: 3992 - protein, 4 aa, Artificial Sequence
  Description of Artificial Sequence: Synthetic peptide
GLLG

SEQ ID NO: 3993 - protein, 4 aa, Artificial Sequence
  Description of Artificial Sequence: Synthetic peptide
GLMM

SEQ ID NO: 3994 - protein, 5 aa, Artificial Sequence
  Description of Artificial Sequence: Synthetic peptide
IHLAD

SEQ ID NO: 3995 - protein, 4 aa, Artificial Sequence
  Description of Artificial Sequence: Synthetic peptide
TLTQ

SEQ ID NO: 3996 - protein, 6 aa, Artificial Sequence
  Description of Artificial Sequence: Synthetic peptide
TRSHSS

SEQ ID NO: 3997 - protein, 4 aa, Artificial Sequence
  Description of Artificial Sequence: Synthetic peptide
ALMQ

SEQ ID NO: 3998 - protein, 5 aa, Artificial Sequence
  Description of Artificial Sequence: Synthetic peptide
HTLNM

SEQ ID NO: 3999 - protein, 5 aa, Artificial Sequence
  Description of Artificial Sequence: Synthetic peptide
PMLVD

SEQ ID NO: 4000 - protein, 4 aa, Artificial Sequence
  Description of Artificial Sequence: Synthetic peptide
GKKL

SEQ ID NO: 4001 - protein, 5 aa, Artificial Sequence
  Description of Artificial Sequence: Synthetic peptide
GPLAL

SEQ ID NO: 4002 - protein, 5 aa, Artificial Sequence
  Description of Artificial Sequence: Synthetic peptide
ARLGL

SEQ ID NO: 4003 - protein, 5 aa, Artificial Sequence
  Description of Artificial Sequence: Synthetic peptide
EELLK

SEQ ID NO: 4004 - protein, 5 aa, Artificial Sequence
  Description of Artificial Sequence: Synthetic peptide
PLLGV

SEQ ID NO: 4005 - protein, 5 aa, Artificial Sequence
  Description of Artificial Sequence: Synthetic peptide
HPLQQ

SEQ ID NO: 4006 - protein, 5 aa, Artificial Sequence
  Description of Artificial Sequence: Synthetic peptide
SKLNN

SEQ ID NO: 4007 - protein, 5 aa, Artificial Sequence
  Description of Artificial Sequence: Synthetic peptide
TRLRN

SEQ ID NO: 4008 - protein, 4 aa, Artificial Sequence
  Description of Artificial Sequence: Synthetic peptide
DLLV

SEQ ID NO: 4009 - protein, 5 aa, Artificial Sequence
  Description of Artificial Sequence: Synthetic peptide
GELRT

SEQ ID NO: 4010 - protein, 5 aa, Artificial Sequence
  Description of Artificial Sequence: Synthetic peptide
RLLGV

SEQ ID NO: 4011 - protein, 4 aa, Artificial Sequence
  Description of Artificial Sequence: Synthetic peptide
NRLQ

SEQ ID NO: 4012 - protein, 5 aa, Artificial Sequence
  Description of Artificial Sequence: Synthetic peptide
PALGN

SEQ ID NO: 4013 - protein, 5 aa, Artificial Sequence
  Description of Artificial Sequence: Synthetic peptide
PLLGM

SEQ ID NO: 4014 - protein, 5 aa, Artificial Sequence
  Description of Artificial Sequence: Synthetic peptide
PPLMQ

SEQ ID NO: 4015 - protein, 5 aa, Artificial Sequence
  Description of Artificial Sequence: Synthetic peptide
TQLEE

SEQ ID NO: 4016 - protein, 5 aa, Artificial Sequence
  Description of Artificial Sequence: Synthetic peptide
VGLEG

SEQ ID NO: 4017 - protein, 5 aa, Artificial Sequence
  Description of Artificial Sequence: Synthetic peptide
KTLRE

SEQ ID NO: 4018 - protein, 4 aa, Artificial Sequence
  Description of Artificial Sequence: Synthetic peptide
PRLR

SEQ ID NO: 4019 - protein, 5 aa, Artificial Sequence
  Description of Artificial Sequence: Synthetic peptide
PSLGV

SEQ ID NO: 4020 - protein, 4 aa, Artificial Sequence
  Description of Artificial Sequence: Synthetic peptide
RRPS

SEQ ID NO: 4021 - protein, 16 aa, Artificial Sequence
  Description of Artificial Sequence: Synthetic peptide
DGLMDHIRSHTGERPF

SEQ ID NO: 4022 - protein, 5 aa, Artificial Sequence
  Description of Artificial Sequence: Synthetic peptide
MVLVP

SEQ ID NO: 4023 - protein, 5 aa, Artificial Sequence
  Description of Artificial Sequence: Synthetic peptide
SELTG

SEQ ID NO: 4024 - protein, 5 aa, Artificial Sequence
  Description of Artificial Sequence: Synthetic peptide
SGLKH

SEQ ID NO: 4025 - protein, 4 aa, Artificial Sequence
  Description of Artificial Sequence: Synthetic peptide
VGLG

SEQ ID NO: 4026 - protein, 5 aa, Artificial Sequence
  Description of Artificial Sequence: Synthetic peptide
DRLGP

SEQ ID NO: 4027 - protein, 5 aa, Artificial Sequence
  Description of Artificial Sequence: Synthetic peptide
GLLGR

SEQ ID NO: 4028 - protein, 5 aa, Artificial Sequence
  Description of Artificial Sequence: Synthetic peptide
KQLQP

SEQ ID NO: 4029 - protein, 5 aa, Artificial Sequence
  Description of Artificial Sequence: Synthetic peptide
RPLLR

SEQ ID NO: 4030 - protein, 5 aa, Artificial Sequence
  Description of Artificial Sequence: Synthetic peptide
RSLRL

SEQ ID NO: 4031 - protein, 4 aa, Artificial Sequence
  Description of Artificial Sequence: Synthetic peptide
GALG

SEQ ID NO: 4032 - protein, 5 aa, Artificial Sequence
  Description of Artificial Sequence: Synthetic peptide
GDLSP

SEQ ID NO: 4033 - protein, 5 aa, Artificial Sequence
  Description of Artificial Sequence: Synthetic peptide
GKLSL

SEQ ID NO: 4034 - protein, 5 aa, Artificial Sequence
  Description of Artificial Sequence: Synthetic peptide
LRLNL

SEQ ID NO: 4035 - protein, 5 aa, Artificial Sequence
  Description of Artificial Sequence: Synthetic peptide
MTLGN

SEQ ID NO: 4036 - protein, 5 aa, Artificial Sequence
  Description of Artificial Sequence: Synthetic peptide
PMLAA

SEQ ID NO: 4037 - protein, 4 aa, Artificial Sequence
  Description of Artificial Sequence: Synthetic peptide
ALIG

SEQ ID NO: 4038 - protein, 5 aa, Artificial Sequence
  Description of Artificial Sequence: Synthetic peptide
AQLAN

SEQ ID NO: 4039 - protein, 5 aa, Artificial Sequence
  Description of Artificial Sequence: Synthetic peptide
DGLAM

SEQ ID NO: 4040 - protein, 4 aa, Artificial Sequence
  Description of Artificial Sequence: Synthetic peptide
GLPV

SEQ ID NO: 4041 - protein, 4 aa, Artificial Sequence
  Description of Artificial Sequence: Synthetic peptide
SHMK

SEQ ID NO: 4042 - protein, 5 aa, Artificial Sequence
  Description of Artificial Sequence: Synthetic peptide
VLLME

SEQ ID NO: 4043 - protein, 5 aa, Artificial Sequence
  Description of Artificial Sequence: Synthetic peptide
GALPR

SEQ ID NO: 4044 - protein, 5 aa, Artificial Sequence
  Description of Artificial Sequence: Synthetic peptide
GKLIL

SEQ ID NO: 4045 - protein, 5 aa, Artificial Sequence
  Description of Artificial Sequence: Synthetic peptide
KQLTD

SEQ ID NO: 4046 - protein, 5 aa, Artificial Sequence
  Description of Artificial Sequence: Synthetic peptide
LKLIG

SEQ ID NO: 4047 - protein, 5 aa, Artificial Sequence
  Description of Artificial Sequence: Synthetic peptide
LRLMS

SEQ ID NO: 4048 - protein, 5 aa, Artificial Sequence
  Description of Artificial Sequence: Synthetic peptide
PNYWP

SEQ ID NO: 4049 - protein, 5 aa, Artificial Sequence
  Description of Artificial Sequence: Synthetic peptide
RHLVP

SEQ ID NO: 4050 - protein, 5 aa, Artificial Sequence
  Description of Artificial Sequence: Synthetic peptide
SRLGA

SEQ ID NO: 4051 - protein, 5 aa, Artificial Sequence
  Description of Artificial Sequence: Synthetic peptide
DRLAS

SEQ ID NO: 4052 - protein, 4 aa, Artificial Sequence
  Description of Artificial Sequence: Synthetic peptide
GSLS

SEQ ID NO: 4053 - protein, 5 aa, Artificial Sequence
  Description of Artificial Sequence: Synthetic peptide
MDLLL

SEQ ID NO: 4054 - protein, 5 aa, Artificial Sequence
  Description of Artificial Sequence: Synthetic peptide
MTLGA

SEQ ID NO: 4055 - protein, 5 aa, Artificial Sequence
  Description of Artificial Sequence: Synthetic peptide
PPLER

SEQ ID NO: 4056 - protein, 5 aa, Artificial Sequence
  Description of Artificial Sequence: Synthetic peptide
PVLPG

SEQ ID NO: 4057 - protein, 5 aa, Artificial Sequence
  Description of Artificial Sequence: Synthetic peptide
SLLQG

SEQ ID NO: 4058 - protein, 5 aa, Artificial Sequence
  Description of Artificial Sequence: Synthetic peptide
APLGM

SEQ ID NO: 4059 - protein, 5 aa, Artificial Sequence
  Description of Artificial Sequence: Synthetic peptide
GILAK

SEQ ID NO: 4060 - protein, 5 aa, Artificial Sequence
  Description of Artificial Sequence: Synthetic peptide
GMLPD

SEQ ID NO: 4061 - protein, 5 aa, Artificial Sequence
  Description of Artificial Sequence: Synthetic peptide
GSLPM

SEQ ID NO: 4062 - protein, 8 aa, Artificial Sequence
  Description of Artificial Sequence: Synthetic peptide
NGRSPVET

SEQ ID NO: 4063 - protein, 5 aa, Artificial Sequence
  Description of Artificial Sequence: Synthetic peptide
PMLRV

SEQ ID NO: 4064 - protein, 4 aa, Artificial Sequence
  Description of Artificial Sequence: Synthetic peptide
TLML

SEQ ID NO: 4065 - protein, 5 aa, Artificial Sequence
  Description of Artificial Sequence: Synthetic peptide
ASLGQ

SEQ ID NO: 4066 - protein, 5 aa, Artificial Sequence
  Description of Artificial Sequence: Synthetic peptide
ELILE

SEQ ID NO: 4067 - protein, 4 aa, Artificial Sequence
  Description of Artificial Sequence: Synthetic peptide
GHRS

SEQ ID NO: 4068 - protein, 5 aa, Artificial Sequence
  Description of Artificial Sequence: Synthetic peptide
GHLAM

SEQ ID NO: 4069 - protein, 4 aa, Artificial Sequence
  Description of Artificial Sequence: Synthetic peptide
GLLP

SEQ ID NO: 4070 - protein, 5 aa, Artificial Sequence
  Description of Artificial Sequence: Synthetic peptide
GTLAI

SEQ ID NO: 4071 - protein, 5 aa, Artificial Sequence
  Description of Artificial Sequence: Synthetic peptide
IRLKK

SEQ ID NO: 4072 - protein, 5 aa, Artificial Sequence
  Description of Artificial Sequence: Synthetic peptide
KELRR

SEQ ID NO: 4073 - protein, 5 aa, Artificial Sequence
  Description of Artificial Sequence: Synthetic peptide
LHLPI

SEQ ID NO: 4074 - protein, 5 aa, Artificial Sequence
  Description of Artificial Sequence: Synthetic peptide
NELRG

SEQ ID NO: 4075 - protein, 5 aa, Artificial Sequence
  Description of Artificial Sequence: Synthetic peptide
PHLNG

SEQ ID NO: 4076 - protein, 5 aa, Artificial Sequence
  Description of Artificial Sequence: Synthetic peptide
RLLGS

SEQ ID NO: 4077 - protein, 5 aa, Artificial Sequence
  Description of Artificial Sequence: Synthetic peptide
RTLIS

SEQ ID NO: 4078 - protein, 4 aa, Artificial Sequence
  Description of Artificial Sequence: Synthetic peptide
SCAS

SEQ ID NO: 4079 - protein, 5 aa, Artificial Sequence
  Description of Artificial Sequence: Synthetic peptide
VKLMN

SEQ ID NO: 4080 - protein, 5 aa, Artificial Sequence
  Description of Artificial Sequence: Synthetic peptide
VTLIG

SEQ ID NO: 4081 - protein, 5 aa, Artificial Sequence
  Description of Artificial Sequence: Synthetic peptide
AGLQE

SEQ ID NO: 4082 - protein, 4 aa, Artificial Sequence
  Description of Artificial Sequence: Synthetic peptide
ALHT

SEQ ID NO: 4083 - protein, 5 aa, Artificial Sequence
  Description of Artificial Sequence: Synthetic peptide
DPLVD

SEQ ID NO: 4084 - protein, 5 aa, Artificial Sequence
  Description of Artificial Sequence: Synthetic peptide
EALDA

SEQ ID NO: 4085 - protein, 5 aa, Artificial Sequence
  Description of Artificial Sequence: Synthetic peptide
GALAT

SEQ ID NO: 4086 - protein, 5 aa, Artificial Sequence
  Description of Artificial Sequence: Synthetic peptide
GTLLM

SEQ ID NO: 4087 - protein, 5 aa, Artificial Sequence
  Description of Artificial Sequence: Synthetic peptide
IKLRP

SEQ ID NO: 4088 - protein, 5 aa, Artificial Sequence
  Description of Artificial Sequence: Synthetic peptide
RRLLD

SEQ ID NO: 4089 - protein, 5 aa, Artificial Sequence
  Description of Artificial Sequence: Synthetic peptide
TGLMG

SEQ ID NO: 4090 - protein, 5 aa, Artificial Sequence
  Description of Artificial Sequence: Synthetic peptide
TKLLL

SEQ ID NO: 4091 - protein, 5 aa, Artificial Sequence
  Description of Artificial Sequence: Synthetic peptide
TTLGA

SEQ ID NO: 4092 - protein, 4 aa, Artificial Sequence
  Description of Artificial Sequence: Synthetic peptide
VEDP

SEQ ID NO: 4093 - protein, 5 aa, Artificial Sequence
  Description of Artificial Sequence: Synthetic peptide
AGLGI

SEQ ID NO: 4094 - protein, 5 aa, Artificial Sequence
  Description of Artificial Sequence: Synthetic peptide
AGLLQ

SEQ ID NO: 4095 - protein, 5 aa, Artificial Sequence
  Description of Artificial Sequence: Synthetic peptide
AVLSH

SEQ ID NO: 4096 - protein, 5 aa, Artificial Sequence
  Description of Artificial Sequence: Synthetic peptide
DRLAG

SEQ ID NO: 4097 - protein, 5 aa, Artificial Sequence
  Description of Artificial Sequence: Synthetic peptide
ERLSN

SEQ ID NO: 4098 - protein, 4 aa, Artificial Sequence
  Description of Artificial Sequence: Synthetic peptide
ETLM

SEQ ID NO: 4099 - protein, 5 aa, Artificial Sequence
  Description of Artificial Sequence: Synthetic peptide
GELRG

SEQ ID NO: 4100 - protein, 5 aa, Artificial Sequence
  Description of Artificial Sequence: Synthetic peptide
GRLNR

SEQ ID NO: 4101 - protein, 5 aa, Artificial Sequence
  Description of Artificial Sequence: Synthetic peptide
GRLRL

SEQ ID NO: 4102 - protein, 5 aa, Artificial Sequence
  Description of Artificial Sequence: Synthetic peptide
IMLAG

SEQ ID NO: 4103 - protein, 5 aa, Artificial Sequence
  Description of Artificial Sequence: Synthetic peptide
IVLDP

SEQ ID NO: 4104 - protein, 5 aa, Artificial Sequence
  Description of Artificial Sequence: Synthetic peptide
KVLAP

SEQ ID NO: 4105 - protein, 5 aa, Artificial Sequence
  Description of Artificial Sequence: Synthetic peptide
LMLGM

SEQ ID NO: 4106 - protein, 5 aa, Artificial Sequence
  Description of Artificial Sequence: Synthetic peptide
MPLRE

SEQ ID NO: 4107 - protein, 5 aa, Artificial Sequence
  Description of Artificial Sequence: Synthetic peptide
RLLGP

SEQ ID NO: 4108 - protein, 5 aa, Artificial Sequence
  Description of Artificial Sequence: Synthetic peptide
SMYRS

SEQ ID NO: 4109 - protein, 5 aa, Artificial Sequence
  Description of Artificial Sequence: Synthetic peptide
THLAK

SEQ ID NO: 4110 - protein, 5 aa, Artificial Sequence
  Description of Artificial Sequence: Synthetic peptide
VGLTR

SEQ ID NO: 4111 - protein, 5 aa, Artificial Sequence
  Description of Artificial Sequence: Synthetic peptide
VQLPT

SEQ ID NO: 4112 - protein, 4 aa, Artificial Sequence
  Description of Artificial Sequence: Synthetic peptide
AGLD

SEQ ID NO: 4113 - protein, 5 aa, Artificial Sequence
  Description of Artificial Sequence: Synthetic peptide
DVLPG

SEQ ID NO: 4114 - protein, 4 aa, Artificial Sequence
  Description of Artificial Sequence: Synthetic peptide
GLLV

SEQ ID NO: 4115 - protein, 4 aa, Artificial Sequence
  Description of Artificial Sequence: Synthetic peptide
GLMN

SEQ ID NO: 4116 - protein, 5 aa, Artificial Sequence
  Description of Artificial Sequence: Synthetic peptide
GMLVG

SEQ ID NO: 4117 - protein, 5 aa, Artificial Sequence
  Description of Artificial Sequence: Synthetic peptide
GPLTI

SEQ ID NO: 4118 - protein, 4 aa, Artificial Sequence
  Description of Artificial Sequence: Synthetic peptide
GRLE

SEQ ID NO: 4119 - protein, 5 aa, Artificial Sequence
  Description of Artificial Sequence: Synthetic peptide
GSLQS

SEQ ID NO: 4120 - protein, 5 aa, Artificial Sequence
  Description of Artificial Sequence: Synthetic peptide
GVLVS

SEQ ID NO: 4121 - protein, 5 aa, Artificial Sequence
  Description of Artificial Sequence: Synthetic peptide
HKLLK

SEQ ID NO: 4122 - protein, 5 aa, Artificial Sequence
  Description of Artificial Sequence: Synthetic peptide
MRLKV

SEQ ID NO: 4123 - protein, 5 aa, Artificial Sequence
  Description of Artificial Sequence: Synthetic peptide
MRLRS

SEQ ID NO: 4124 - protein, 5 aa, Artificial Sequence
  Description of Artificial Sequence: Synthetic peptide
MSLSP

SEQ ID NO: 4125 - protein, 5 aa, Artificial Sequence
  Description of Artificial Sequence: Synthetic peptide
PALGG

SEQ ID NO: 4126 - protein, 5 aa, Artificial Sequence
  Description of Artificial Sequence: Synthetic peptide
QPLAG

SEQ ID NO: 4127 - protein, 4 aa, Artificial Sequence
  Description of Artificial Sequence: Synthetic peptide
SKVV

SEQ ID NO: 4128 - protein, 4 aa, Artificial Sequence
  Description of Artificial Sequence: Synthetic peptide
TLIN

SEQ ID NO: 4129 - protein, 5 aa, Artificial Sequence
  Description of Artificial Sequence: Synthetic peptide
TLLTP

SEQ ID NO: 4130 - protein, 5 aa, Artificial Sequence
  Description of Artificial Sequence: Synthetic peptide
DALME

SEQ ID NO: 4131 - protein, 5 aa, Artificial Sequence
  Description of Artificial Sequence: Synthetic peptide
EALNK

SEQ ID NO: 4132 - protein, 5 aa, Artificial Sequence
  Description of Artificial Sequence: Synthetic peptide
EGLPT

SEQ ID NO: 4133 - protein, 5 aa, Artificial Sequence
  Description of Artificial Sequence: Synthetic peptide
ELLKS

SEQ ID NO: 4134 - protein, 5 aa, Artificial Sequence
  Description of Artificial Sequence: Synthetic peptide
GELTD

SEQ ID NO: 4135 - protein, 5 aa, Artificial Sequence
  Description of Artificial Sequence: Synthetic peptide
GPLVS

SEQ ID NO: 4136 - protein, 5 aa, Artificial Sequence
  Description of Artificial Sequence: Synthetic peptide
GQLMM

SEQ ID NO: 4137 - protein, 5 aa, Artificial Sequence
  Description of Artificial Sequence: Synthetic peptide
GQLVG

SEQ ID NO: 4138 - protein, 5 aa, Artificial Sequence
  Description of Artificial Sequence: Synthetic peptide
KGLEG

SEQ ID NO: 4139 - protein, 5 aa, Artificial Sequence
  Description of Artificial Sequence: Synthetic peptide
QGLDN

SEQ ID NO: 4140 - protein, 5 aa, Artificial Sequence
  Description of Artificial Sequence: Synthetic peptide
RALVS

SEQ ID NO: 4141 - protein, 5 aa, Artificial Sequence
  Description of Artificial Sequence: Synthetic peptide
RGLAT

SEQ ID NO: 4142 - protein, 4 aa, Artificial Sequence
  Description of Artificial Sequence: Synthetic peptide
TLHE

SEQ ID NO: 4143 - protein, 5 aa, Artificial Sequence
  Description of Artificial Sequence: Synthetic peptide
GHLKS

SEQ ID NO: 4144 - protein, 5 aa, Artificial Sequence
  Description of Artificial Sequence: Synthetic peptide
GLLKH

SEQ ID NO: 4145 - protein, 5 aa, Artificial Sequence
  Description of Artificial Sequence: Synthetic peptide
GVLSI

SEQ ID NO: 4146 - protein, 5 aa, Artificial Sequence
  Description of Artificial Sequence: Synthetic peptide
GVLST

SEQ ID NO: 4147 - protein, 5 aa, Artificial Sequence
  Description of Artificial Sequence: Synthetic peptide
MPLVP

SEQ ID NO: 4148 - protein, 5 aa, Artificial Sequence
  Description of Artificial Sequence: Synthetic peptide
PKLQP

SEQ ID NO: 4149 - protein, 5 aa, Artificial Sequence
  Description of Artificial Sequence: Synthetic peptide
PVLMG

SEQ ID NO: 4150 - protein, 5 aa, Artificial Sequence
  Description of Artificial Sequence: Synthetic peptide
QALIG

SEQ ID NO: 4151 - protein, 5 aa, Artificial Sequence
  Description of Artificial Sequence: Synthetic peptide
RGLIT

SEQ ID NO: 4152 - protein, 4 aa, Artificial Sequence
  Description of Artificial Sequence: Synthetic peptide
RVQD

SEQ ID NO: 4153 - protein, 5 aa, Artificial Sequence
  Description of Artificial Sequence: Synthetic peptide
TELPM

SEQ ID NO: 4154 - protein, 5 aa, Artificial Sequence
  Description of Artificial Sequence: Synthetic peptide
APLDL

SEQ ID NO: 4155 - protein, 5 aa, Artificial Sequence
  Description of Artificial Sequence: Synthetic peptide
ARLGR

SEQ ID NO: 4156 - protein, 5 aa, Artificial Sequence
  Description of Artificial Sequence: Synthetic peptide
DALSA

SEQ ID NO: 4157 - protein, 5 aa, Artificial Sequence
  Description of Artificial Sequence: Synthetic peptide
EGLAG

SEQ ID NO: 4158 - protein, 5 aa, Artificial Sequence
  Description of Artificial Sequence: Synthetic peptide
GGLVS

SEQ ID NO: 4159 - protein, 5 aa, Artificial Sequence
  Description of Artificial Sequence: Synthetic peptide
GMLGT

SEQ ID NO: 4160 - protein, 5 aa, Artificial Sequence
  Description of Artificial Sequence: Synthetic peptide
GPLLG

SEQ ID NO: 4161 - protein, 5 aa, Artificial Sequence
  Description of Artificial Sequence: Synthetic peptide
HIRSH

SEQ ID NO: 4162 - protein, 4 aa, Artificial Sequence
  Description of Artificial Sequence: Synthetic peptide
IMLV

SEQ ID NO: 4163 - protein, 5 aa, Artificial Sequence
  Description of Artificial Sequence: Synthetic peptide
LHLQG

SEQ ID NO: 4164 - protein, 5 aa, Artificial Sequence
  Description of Artificial Sequence: Synthetic peptide
MELMT

SEQ ID NO: 4165 - protein, 5 aa, Artificial Sequence
  Description of Artificial Sequence: Synthetic peptide
MPLGG

SEQ ID NO: 4166 - protein, 5 aa, Artificial Sequence
  Description of Artificial Sequence: Synthetic peptide
PGLAD

SEQ ID NO: 4167 - protein, 5 aa, Artificial Sequence
  Description of Artificial Sequence: Synthetic peptide
PTLEV

SEQ ID NO: 4168 - protein, 5 aa, Artificial Sequence
  Description of Artificial Sequence: Synthetic peptide
RQLGM

SEQ ID NO: 4169 - protein, 5 aa, Artificial Sequence
  Description of Artificial Sequence: Synthetic peptide
RVLRG

SEQ ID NO: 4170 - protein, 5 aa, Artificial Sequence
  Description of Artificial Sequence: Synthetic peptide
SVLRV

SEQ ID NO: 4171 - protein, 5 aa, Artificial Sequence
  Description of Artificial Sequence: Synthetic peptide
TVLAG

SEQ ID NO: 4172 - protein, 4 aa, Artificial Sequence
  Description of Artificial Sequence: Synthetic peptide
VGLA

SEQ ID NO: 4173 - protein, 5 aa, Artificial Sequence
  Description of Artificial Sequence: Synthetic peptide
VGLRG

SEQ ID NO: 4174 - protein, 5 aa, Artificial Sequence
  Description of Artificial Sequence: Synthetic peptide
AALHH

SEQ ID NO: 4175 - protein, 5 aa, Artificial Sequence
  Description of Artificial Sequence: Synthetic peptide
ALLGV

SEQ ID NO: 4176 - protein, 5 aa, Artificial Sequence
  Description of Artificial Sequence: Synthetic peptide
ARLHA

SEQ ID NO: 4177 - protein, 4 aa, Artificial Sequence
  Description of Artificial Sequence: Synthetic peptide
DGLG

SEQ ID NO: 4178 - protein, 5 aa, Artificial Sequence
  Description of Artificial Sequence: Synthetic peptide
DHLVG

SEQ ID NO: 4179 - protein, 5 aa, Artificial Sequence
  Description of Artificial Sequence: Synthetic peptide
DILRG

SEQ ID NO: 4180 - protein, 5 aa, Artificial Sequence
  Description of Artificial Sequence: Synthetic peptide
DQLVE

SEQ ID NO: 4181 - protein, 5 aa, Artificial Sequence
  Description of Artificial Sequence: Synthetic peptide
DQLVG

SEQ ID NO: 4182 - protein, 5 aa, Artificial Sequence
  Description of Artificial Sequence: Synthetic peptide
EKLMM

SEQ ID NO: 4183 - protein, 5 aa, Artificial Sequence
  Description of Artificial Sequence: Synthetic peptide
ELLTP

SEQ ID NO: 4184 - protein, 5 aa, Artificial Sequence
  Description of Artificial Sequence: Synthetic peptide
GALRS

SEQ ID NO: 4185 - protein, 5 aa, Artificial Sequence
  Description of Artificial Sequence: Synthetic peptide
GKLNI

SEQ ID NO: 4186 - protein, 5 aa, Artificial Sequence
  Description of Artificial Sequence: Synthetic peptide
GRLLE

SEQ ID NO: 4187 - protein, 5 aa, Artificial Sequence
  Description of Artificial Sequence: Synthetic peptide
MALPE

SEQ ID NO: 4188 - protein, 8 aa, Artificial Sequence
  Description of Artificial Sequence: Synthetic peptide
NDALQYES

SEQ ID NO: 4189 - protein, 5 aa, Artificial Sequence
  Description of Artificial Sequence: Synthetic peptide
PKLRS

SEQ ID NO: 4190 - protein, 5 aa, Artificial Sequence
  Description of Artificial Sequence: Synthetic peptide
PRLPP

SEQ ID NO: 4191 - protein, 5 aa, Artificial Sequence
  Description of Artificial Sequence: Synthetic peptide
PVLKL

SEQ ID NO: 4192 - protein, 5 aa, Artificial Sequence
  Description of Artificial Sequence: Synthetic peptide
QKLAN

SEQ ID NO: 4193 - protein, 5 aa, Artificial Sequence
  Description of Artificial Sequence: Synthetic peptide
QKLKL

SEQ ID NO: 4194 - protein, 5 aa, Artificial Sequence
  Description of Artificial Sequence: Synthetic peptide
RALPK

SEQ ID NO: 4195 - protein, 5 aa, Artificial Sequence
  Description of Artificial Sequence: Synthetic peptide
THLGR

SEQ ID NO: 4196 - protein, 5 aa, Artificial Sequence
  Description of Artificial Sequence: Synthetic peptide
VALGT

SEQ ID NO: 4197 - protein, 5 aa, Artificial Sequence
  Description of Artificial Sequence: Synthetic peptide
VKLHE

SEQ ID NO: 4198 - protein, 4 aa, Artificial Sequence
  Description of Artificial Sequence: Synthetic peptide
VTLG

SEQ ID NO: 4199 - protein, 5 aa, Artificial Sequence
  Description of Artificial Sequence: Synthetic peptide
ARLLG

SEQ ID NO: 4200 - protein, 5 aa, Artificial Sequence
  Description of Artificial Sequence: Synthetic peptide
ARLTG

SEQ ID NO: 4201 - protein, 5 aa, Artificial Sequence
  Description of Artificial Sequence: Synthetic peptide
ASLGA

SEQ ID NO: 4202 - protein, 5 aa, Artificial Sequence
  Description of Artificial Sequence: Synthetic peptide
DLLSG

SEQ ID NO: 4203 - protein, 5 aa, Artificial Sequence
  Description of Artificial Sequence: Synthetic peptide
EALTI

SEQ ID NO: 4204 - protein, 4 aa, Artificial Sequence
  Description of Artificial Sequence: Synthetic peptide
ETLS

SEQ ID NO: 4205 - protein, 5 aa, Artificial Sequence
  Description of Artificial Sequence: Synthetic peptide
GALGS

SEQ ID NO: 4206 - protein, 5 aa, Artificial Sequence
  Description of Artificial Sequence: Synthetic peptide
GPLVL

SEQ ID NO: 4207 - protein, 5 aa, Artificial Sequence
  Description of Artificial Sequence: Synthetic peptide
GRLGA

SEQ ID NO: 4208 - protein, 6 aa, Artificial Sequence
  Description of Artificial Sequence: Synthetic peptide
GRSYMA

SEQ ID NO: 4209 - protein, 5 aa, Artificial Sequence
  Description of Artificial Sequence: Synthetic peptide
GVLGS

SEQ ID NO: 4210 - protein, 5 aa, Artificial Sequence
  Description of Artificial Sequence: Synthetic peptide
HPLLV

SEQ ID NO: 4211 - protein, 5 aa, Artificial Sequence
  Description of Artificial Sequence: Synthetic peptide
ITLSP

SEQ ID NO: 4212 - protein, 5 aa, Artificial Sequence
  Description of Artificial Sequence: Synthetic peptide
MLLNG

SEQ ID NO: 4213 - protein, 5 aa, Artificial Sequence
  Description of Artificial Sequence: Synthetic peptide
MRLAE

SEQ ID NO: 4214 - protein, 5 aa, Artificial Sequence
  Description of Artificial Sequence: Synthetic peptide
NMLSR

SEQ ID NO: 4215 - protein, 5 aa, Artificial Sequence
  Description of Artificial Sequence: Synthetic peptide
PGLGG

SEQ ID NO: 4216 - protein, 5 aa, Artificial Sequence
  Description of Artificial Sequence: Synthetic peptide
PGLVP

SEQ ID NO: 4217 - protein, 5 aa, Artificial Sequence
  Description of Artificial Sequence: Synthetic peptide
SRLGV

SEQ ID NO: 4218 - protein, 4 aa, Artificial Sequence
  Description of Artificial Sequence: Synthetic peptide
TLMG

SEQ ID NO: 4219 - protein, 5 aa, Artificial Sequence
  Description of Artificial Sequence: Synthetic peptide
TRLMM

SEQ ID NO: 4220 - protein, 16 aa, Artificial Sequence
  Description of Artificial Sequence: Synthetic peptide
TRLREHIRSHTGERPF

SEQ ID NO: 4221 - protein, 5 aa, Artificial Sequence
  Description of Artificial Sequence: Synthetic peptide
VELGP

SEQ ID NO: 4222 - protein, 5 aa, Artificial Sequence
  Description of Artificial Sequence: Synthetic peptide
VHLAR

SEQ ID NO: 4223 - protein, 5 aa, Artificial Sequence
  Description of Artificial Sequence: Synthetic peptide
VKLVG

SEQ ID NO: 4224 - protein, 5 aa, Artificial Sequence
  Description of Artificial Sequence: Synthetic peptide
APLRV

SEQ ID NO: 4225 - protein, 4 aa, Artificial Sequence
  Description of Artificial Sequence: Synthetic peptide
EALV

SEQ ID NO: 4226 - protein, 5 aa, Artificial Sequence
  Description of Artificial Sequence: Synthetic peptide
EVLPE

SEQ ID NO: 4227 - protein, 5 aa, Artificial Sequence
  Description of Artificial Sequence: Synthetic peptide
GALMN

SEQ ID NO: 4228 - protein, 4 aa, Artificial Sequence
  Description of Artificial Sequence: Synthetic peptide
GLQA

SEQ ID NO: 4229 - protein, 4 aa, Artificial Sequence
  Description of Artificial Sequence: Synthetic peptide
GLTG

SEQ ID NO: 4230 - protein, 5 aa, Artificial Sequence
  Description of Artificial Sequence: Synthetic peptide
GTLGD

SEQ ID NO: 4231 - protein, 5 aa, Artificial Sequence
  Description of Artificial Sequence: Synthetic peptide
HLLGP

SEQ ID NO: 4232 - protein, 5 aa, Artificial Sequence
  Description of Artificial Sequence: Synthetic peptide
LKLKL

SEQ ID NO: 4233 - protein, 5 aa, Artificial Sequence
  Description of Artificial Sequence: Synthetic peptide
MALRK

SEQ ID NO: 4234 - protein, 5 aa, Artificial Sequence
  Description of Artificial Sequence: Synthetic peptide
MVLTG

SEQ ID NO: 4235 - protein, 5 aa, Artificial Sequence
  Description of Artificial Sequence: Synthetic peptide
NGLIE

SEQ ID NO: 4236 - protein, 5 aa, Artificial Sequence
  Description of Artificial Sequence: Synthetic peptide
NKLVV

SEQ ID NO: 4237 - protein, 5 aa, Artificial Sequence
  Description of Artificial Sequence: Synthetic peptide
PALNV

SEQ ID NO: 4238 - protein, 5 aa, Artificial Sequence
  Description of Artificial Sequence: Synthetic peptide
PMLRL

SEQ ID NO: 4239 - protein, 5 aa, Artificial Sequence
  Description of Artificial Sequence: Synthetic peptide
PQLLG

SEQ ID NO: 4240 - protein, 5 aa, Artificial Sequence
  Description of Artificial Sequence: Synthetic peptide
PVLRV

SEQ ID NO: 4241 - protein, 5 aa, Artificial Sequence
  Description of Artificial Sequence: Synthetic peptide
QPLKR

SEQ ID NO: 4242 - protein, 5 aa, Artificial Sequence
  Description of Artificial Sequence: Synthetic peptide
RGLEN

SEQ ID NO: 4243 - protein, 5 aa, Artificial Sequence
  Description of Artificial Sequence: Synthetic peptide
RRLMV

SEQ ID NO: 4244 - protein, 5 aa, Artificial Sequence
  Description of Artificial Sequence: Synthetic peptide
SPLSG

SEQ ID NO: 4245 - protein, 5 aa, Artificial Sequence
  Description of Artificial Sequence: Synthetic peptide
SRLGR

SEQ ID NO: 4246 - protein, 5 aa, Artificial Sequence
  Description of Artificial Sequence: Synthetic peptide
TGLVG

SEQ ID NO: 4247 - protein, 5 aa, Artificial Sequence
  Description of Artificial Sequence: Synthetic peptide
TKLVM

SEQ ID NO: 4248 - protein, 4 aa, Artificial Sequence
  Description of Artificial Sequence: Synthetic peptide
TLLG

SEQ ID NO: 4249 - protein, 5 aa, Artificial Sequence
  Description of Artificial Sequence: Synthetic peptide
TMLPR

SEQ ID NO: 4250 - protein, 5 aa, Artificial Sequence
  Description of Artificial Sequence: Synthetic peptide
TNLRL

SEQ ID NO: 4251 - protein, 5 aa, Artificial Sequence
  Description of Artificial Sequence: Synthetic peptide
TPLGE

SEQ ID NO: 4252 - protein, 5 aa, Artificial Sequence
  Description of Artificial Sequence: Synthetic peptide
TPLVG

SEQ ID NO: 4253 - protein, 5 aa, Artificial Sequence
  Description of Artificial Sequence: Synthetic peptide
TRLLT

SEQ ID NO: 4254 - protein, 5 aa, Artificial Sequence
  Description of Artificial Sequence: Synthetic peptide
VGLGR

SEQ ID NO: 4255 - protein, 4 aa, Artificial Sequence
  Description of Artificial Sequence: Synthetic peptide
VKLQ

SEQ ID NO: 4256 - protein, 5 aa, Artificial Sequence
  Description of Artificial Sequence: Synthetic peptide
AGLML

SEQ ID NO: 4257 - protein, 5 aa, Artificial Sequence
  Description of Artificial Sequence: Synthetic peptide
ARLLT

SEQ ID NO: 4258 - protein, 5 aa, Artificial Sequence
  Description of Artificial Sequence: Synthetic peptide
EGLGG

SEQ ID NO: 4259 - protein, 5 aa, Artificial Sequence
  Description of Artificial Sequence: Synthetic peptide
EGLHL

SEQ ID NO: 4260 - protein, 4 aa, Artificial Sequence
  Description of Artificial Sequence: Synthetic peptide
GVLG

SEQ ID NO: 4261 - protein, 5 aa, Artificial Sequence
  Description of Artificial Sequence: Synthetic peptide
LGLEG

SEQ ID NO: 4262 - protein, 5 aa, Artificial Sequence
  Description of Artificial Sequence: Synthetic peptide
LNLQP

SEQ ID NO: 4263 - protein, 5 aa, Artificial Sequence
  Description of Artificial Sequence: Synthetic peptide
LRLRT

SEQ ID NO: 4264 - protein, 5 aa, Artificial Sequence
  Description of Artificial Sequence: Synthetic peptide
MELGD

SEQ ID NO: 4265 - protein, 5 aa, Artificial Sequence
  Description of Artificial Sequence: Synthetic peptide
MLLQR

SEQ ID NO: 4266 - protein, 4 aa, Artificial Sequence
  Description of Artificial Sequence: Synthetic peptide
MLPP

SEQ ID NO: 4267 - protein, 5 aa, Artificial Sequence
  Description of Artificial Sequence: Synthetic peptide
MSLGG

SEQ ID NO: 4268 - protein, 5 aa, Artificial Sequence
  Description of Artificial Sequence: Synthetic peptide
PKLII

SEQ ID NO: 4269 - protein, 5 aa, Artificial Sequence
  Description of Artificial Sequence: Synthetic peptide
PNLQT

SEQ ID NO: 4270 - protein, 5 aa, Artificial Sequence
  Description of Artificial Sequence: Synthetic peptide
PPLLS

SEQ ID NO: 4271 - protein, 5 aa, Artificial Sequence
  Description of Artificial Sequence: Synthetic peptide
PTLGM

SEQ ID NO: 4272 - protein, 5 aa, Artificial Sequence
  Description of Artificial Sequence: Synthetic peptide
QKLMT

SEQ ID NO: 4273 - protein, 5 aa, Artificial Sequence
  Description of Artificial Sequence: Synthetic peptide
RRLVG

SEQ ID NO: 4274 - protein, 5 aa, Artificial Sequence
  Description of Artificial Sequence: Synthetic peptide
SNLIM

SEQ ID NO: 4275 - protein, 4 aa, Artificial Sequence
  Description of Artificial Sequence: Synthetic peptide
TLTM

SEQ ID NO: 4276 - protein, 5 aa, Artificial Sequence
  Description of Artificial Sequence: Synthetic peptide
TRLGG

SEQ ID NO: 4277 - protein, 5 aa, Artificial Sequence
  Description of Artificial Sequence: Synthetic peptide
VGLLA

SEQ ID NO: 4278 - protein, 5 aa, Artificial Sequence
  Description of Artificial Sequence: Synthetic peptide
VKLRM

SEQ ID NO: 4279 - protein, 5 aa, Artificial Sequence
  Description of Artificial Sequence: Synthetic peptide
VLLGG

SEQ ID NO: 4280 - protein, 4 aa, Artificial Sequence
  Description of Artificial Sequence: Synthetic peptide
VQGG

SEQ ID NO: 4281 - protein, 5 aa, Artificial Sequence
  Description of Artificial Sequence: Synthetic peptide
AGLSG

SEQ ID NO: 4282 - protein, 5 aa, Artificial Sequence
  Description of Artificial Sequence: Synthetic peptide
AGLTE

SEQ ID NO: 4283 - protein, 5 aa, Artificial Sequence
  Description of Artificial Sequence: Synthetic peptide
AGLVA

SEQ ID NO: 4284 - protein, 4 aa, Artificial Sequence
  Description of Artificial Sequence: Synthetic peptide
ALSA

SEQ ID NO: 4285 - protein, 5 aa, Artificial Sequence
  Description of Artificial Sequence: Synthetic peptide
ATLMK

SEQ ID NO: 4286 - protein, 5 aa, Artificial Sequence
  Description of Artificial Sequence: Synthetic peptide
EALAI

SEQ ID NO: 4287 - protein, 5 aa, Artificial Sequence
  Description of Artificial Sequence: Synthetic peptide
EELVE

SEQ ID NO: 4288 - protein, 5 aa, Artificial Sequence
  Description of Artificial Sequence: Synthetic peptide
EMLIP

SEQ ID NO: 4289 - protein, 5 aa, Artificial Sequence
  Description of Artificial Sequence: Synthetic peptide
EPLAA

SEQ ID NO: 4290 - protein, 5 aa, Artificial Sequence
  Description of Artificial Sequence: Synthetic peptide
ERLQE

SEQ ID NO: 4291 - protein, 5 aa, Artificial Sequence
  Description of Artificial Sequence: Synthetic peptide
GMLRV

SEQ ID NO: 4292 - protein, 5 aa, Artificial Sequence
  Description of Artificial Sequence: Synthetic peptide
GPLME

SEQ ID NO: 4293 - protein, 5 aa, Artificial Sequence
  Description of Artificial Sequence: Synthetic peptide
GVLSP

SEQ ID NO: 4294 - protein, 5 aa, Artificial Sequence
  Description of Artificial Sequence: Synthetic peptide
IKLMG

SEQ ID NO: 4295 - protein, 5 aa, Artificial Sequence
  Description of Artificial Sequence: Synthetic peptide
IPLNR

SEQ ID NO: 4296 - protein, 5 aa, Artificial Sequence
  Description of Artificial Sequence: Synthetic peptide
MLLKG

SEQ ID NO: 4297 - protein, 5 aa, Artificial Sequence
  Description of Artificial Sequence: Synthetic peptide
MRLPR

SEQ ID NO: 4298 - protein, 5 aa, Artificial Sequence
  Description of Artificial Sequence: Synthetic peptide
MSLRE

SEQ ID NO: 4299 - protein, 5 aa, Artificial Sequence
  Description of Artificial Sequence: Synthetic peptide
PPLMV

SEQ ID NO: 4300 - protein, 5 aa, Artificial Sequence
  Description of Artificial Sequence: Synthetic peptide
PTLGV

SEQ ID NO: 4301 - protein, 5 aa, Artificial Sequence
  Description of Artificial Sequence: Synthetic peptide
RGLRN

SEQ ID NO: 4302 - protein, 5 aa, Artificial Sequence
  Description of Artificial Sequence: Synthetic peptide
RSLIV

SEQ ID NO: 4303 - protein, 5 aa, Artificial Sequence
  Description of Artificial Sequence: Synthetic peptide
RTLGE

SEQ ID NO: 4304 - protein, 5 aa, Artificial Sequence
  Description of Artificial Sequence: Synthetic peptide
SSLGV

SEQ ID NO: 4305 - protein, 5 aa, Artificial Sequence
  Description of Artificial Sequence: Synthetic peptide
TGLGT

SEQ ID NO: 4306 - protein, 5 aa, Artificial Sequence
  Description of Artificial Sequence: Synthetic peptide
TKLLG

SEQ ID NO: 4307 - protein, 4 aa, Artificial Sequence
  Description of Artificial Sequence: Synthetic peptide
TLIG

SEQ ID NO: 4308 - protein, 5 aa, Artificial Sequence
  Description of Artificial Sequence: Synthetic peptide
TNLLR

SEQ ID NO: 4309 - protein, 5 aa, Artificial Sequence
  Description of Artificial Sequence: Synthetic peptide
TTLGG

SEQ ID NO: 4310 - protein, 5 aa, Artificial Sequence
  Description of Artificial Sequence: Synthetic peptide
VILGA

SEQ ID NO: 4311 - protein, 5 aa, Artificial Sequence
  Description of Artificial Sequence: Synthetic peptide
AALGL

SEQ ID NO: 4312 - protein, 5 aa, Artificial Sequence
  Description of Artificial Sequence: Synthetic peptide
AELMR

SEQ ID NO: 4313 - protein, 5 aa, Artificial Sequence
  Description of Artificial Sequence: Synthetic peptide
AGLDG

SEQ ID NO: 4314 - protein, 5 aa, Artificial Sequence
  Description of Artificial Sequence: Synthetic peptide
DSLVI

SEQ ID NO: 4315 - protein, 5 aa, Artificial Sequence
  Description of Artificial Sequence: Synthetic peptide
EKLKA

SEQ ID NO: 4316 - protein, 5 aa, Artificial Sequence
  Description of Artificial Sequence: Synthetic peptide
GKLIA

SEQ ID NO: 4317 - protein, 5 aa, Artificial Sequence
  Description of Artificial Sequence: Synthetic peptide
GNLVT

SEQ ID NO: 4318 - protein, 5 aa, Artificial Sequence
  Description of Artificial Sequence: Synthetic peptide
GRLLI

SEQ ID NO: 4319 - protein, 5 aa, Artificial Sequence
  Description of Artificial Sequence: Synthetic peptide
GRLRS

SEQ ID NO: 4320 - protein, 5 aa, Artificial Sequence
  Description of Artificial Sequence: Synthetic peptide
HELMK

SEQ ID NO: 4321 - protein, 5 aa, Artificial Sequence
  Description of Artificial Sequence: Synthetic peptide
KMLGG

SEQ ID NO: 4322 - protein, 5 aa, Artificial Sequence
  Description of Artificial Sequence: Synthetic peptide
LGLIQ

SEQ ID NO: 4323 - protein, 5 aa, Artificial Sequence
  Description of Artificial Sequence: Synthetic peptide
LKLER

SEQ ID NO: 4324 - protein, 5 aa, Artificial Sequence
  Description of Artificial Sequence: Synthetic peptide
LPLNG

SEQ ID NO: 4325 - protein, 5 aa, Artificial Sequence
  Description of Artificial Sequence: Synthetic peptide
MGLGV

SEQ ID NO: 4326 - protein, 5 aa, Artificial Sequence
  Description of Artificial Sequence: Synthetic peptide
PMLTV

SEQ ID NO: 4327 - protein, 5 aa, Artificial Sequence
  Description of Artificial Sequence: Synthetic peptide
PPLII

SEQ ID NO: 4328 - protein, 5 aa, Artificial Sequence
  Description of Artificial Sequence: Synthetic peptide
QRLVE

SEQ ID NO: 4329 - protein, 5 aa, Artificial Sequence
  Description of Artificial Sequence: Synthetic peptide
RKLKE

SEQ ID NO: 4330 - protein, 5 aa, Artificial Sequence
  Description of Artificial Sequence: Synthetic peptide
RRLHE

SEQ ID NO: 4331 - protein, 5 aa, Artificial Sequence
  Description of Artificial Sequence: Synthetic peptide
RVLGA

SEQ ID NO: 4332 - protein, 4 aa, Artificial Sequence
  Description of Artificial Sequence: Synthetic peptide
SCRP

SEQ ID NO: 4333 - protein, 5 aa, Artificial Sequence
  Description of Artificial Sequence: Synthetic peptide
SGLDA

SEQ ID NO: 4334 - protein, 5 aa, Artificial Sequence
  Description of Artificial Sequence: Synthetic peptide
SQLDR

SEQ ID NO: 4335 - protein, 5 aa, Artificial Sequence
  Description of Artificial Sequence: Synthetic peptide
TSLTE

SEQ ID NO: 4336 - protein, 5 aa, Artificial Sequence
  Description of Artificial Sequence: Synthetic peptide
AGLRS

SEQ ID NO: 4337 - protein, 5 aa, Artificial Sequence
  Description of Artificial Sequence: Synthetic peptide
AHLGQ

SEQ ID NO: 4338 - protein, 4 aa, Artificial Sequence
  Description of Artificial Sequence: Synthetic peptide
ALME

SEQ ID NO: 4339 - protein, 5 aa, Artificial Sequence
  Description of Artificial Sequence: Synthetic peptide
DGLHG

SEQ ID NO: 4340 - protein, 5 aa, Artificial Sequence
  Description of Artificial Sequence: Synthetic peptide
DGLLQ

SEQ ID NO: 4341 - protein, 5 aa, Artificial Sequence
  Description of Artificial Sequence: Synthetic peptide
EKLRS

SEQ ID NO: 4342 - protein, 5 aa, Artificial Sequence
  Description of Artificial Sequence: Synthetic peptide
ERLAR

SEQ ID NO: 4343 - protein, 5 aa, Artificial Sequence
  Description of Artificial Sequence: Synthetic peptide
GELKA

SEQ ID NO: 4344 - protein, 4 aa, Artificial Sequence
  Description of Artificial Sequence: Synthetic peptide
GLML

SEQ ID NO: 4345 - protein, 4 aa, Artificial Sequence
  Description of Artificial Sequence: Synthetic peptide
GLQN

SEQ ID NO: 4346 - protein, 4 aa, Artificial Sequence
  Description of Artificial Sequence: Synthetic peptide
GLTA

SEQ ID NO: 4347 - protein, 5 aa, Artificial Sequence
  Description of Artificial Sequence: Synthetic peptide
GMLGE

SEQ ID NO: 4348 - protein, 5 aa, Artificial Sequence
  Description of Artificial Sequence: Synthetic peptide
GPLRR

SEQ ID NO: 4349 - protein, 5 aa, Artificial Sequence
  Description of Artificial Sequence: Synthetic peptide
GVLDT

SEQ ID NO: 4350 - protein, 5 aa, Artificial Sequence
  Description of Artificial Sequence: Synthetic peptide
GVLNT

SEQ ID NO: 4351 - protein, 5 aa, Artificial Sequence
  Description of Artificial Sequence: Synthetic peptide
IQLAD

SEQ ID NO: 4352 - protein, 5 aa, Artificial Sequence
  Description of Artificial Sequence: Synthetic peptide
KGLTM

SEQ ID NO: 4353 - protein, 5 aa, Artificial Sequence
  Description of Artificial Sequence: Synthetic peptide
MELGN

SEQ ID NO: 4354 - protein, 5 aa, Artificial Sequence
  Description of Artificial Sequence: Synthetic peptide
MPLMR

SEQ ID NO: 4355 - protein, 5 aa, Artificial Sequence
  Description of Artificial Sequence: Synthetic peptide
NGLAM

SEQ ID NO: 4356 - protein, 5 aa, Artificial Sequence
  Description of Artificial Sequence: Synthetic peptide
NGLQD

SEQ ID NO: 4357 - protein, 5 aa, Artificial Sequence
  Description of Artificial Sequence: Synthetic peptide
NTLDV

SEQ ID NO: 4358 - protein, 5 aa, Artificial Sequence
  Description of Artificial Sequence: Synthetic peptide
PHLSM

SEQ ID NO: 4359 - protein, 5 aa, Artificial Sequence
  Description of Artificial Sequence: Synthetic peptide
PILLG

SEQ ID NO: 4360 - protein, 5 aa, Artificial Sequence
  Description of Artificial Sequence: Synthetic peptide
PVLQG

SEQ ID NO: 4361 - protein, 5 aa, Artificial Sequence
  Description of Artificial Sequence: Synthetic peptide
QGLGG

SEQ ID NO: 4362 - protein, 5 aa, Artificial Sequence
  Description of Artificial Sequence: Synthetic peptide
QKLQI

SEQ ID NO: 4363 - protein, 5 aa, Artificial Sequence
  Description of Artificial Sequence: Synthetic peptide
QPLIA

SEQ ID NO: 4364 - protein, 5 aa, Artificial Sequence
  Description of Artificial Sequence: Synthetic peptide
SRLTD

SEQ ID NO: 4365 - protein, 5 aa, Artificial Sequence
  Description of Artificial Sequence: Synthetic peptide
TLLGD

SEQ ID NO: 4366 - protein, 7 aa, Artificial Sequence
  Description of Artificial Sequence: Synthetic peptide
TRSHSSV

SEQ ID NO: 4367 - protein, 5 aa, Artificial Sequence
  Description of Artificial Sequence: Synthetic peptide
TTLGD

SEQ ID NO: 4368 - protein, 5 aa, Artificial Sequence
  Description of Artificial Sequence: Synthetic peptide
VKLAP

SEQ ID NO: 4369 - protein, 5 aa, Artificial Sequence
  Description of Artificial Sequence: Synthetic peptide
AKLHP

SEQ ID NO: 4370 - protein, 5 aa, Artificial Sequence
  Description of Artificial Sequence: Synthetic peptide
AVLEN

SEQ ID NO: 4371 - protein, 5 aa, Artificial Sequence
  Description of Artificial Sequence: Synthetic peptide
GELGV

SEQ ID NO: 4372 - protein, 4 aa, Artificial Sequence
  Description of Artificial Sequence: Synthetic peptide
GLMA

SEQ ID NO: 4373 - protein, 4 aa, Artificial Sequence
  Description of Artificial Sequence: Synthetic peptide
GLNR

SEQ ID NO: 4374 - protein, 4 aa, Artificial Sequence
  Description of Artificial Sequence: Synthetic peptide
GLVV

SEQ ID NO: 4375 - protein, 5 aa, Artificial Sequence
  Description of Artificial Sequence: Synthetic peptide
GPLPV

SEQ ID NO: 4376 - protein, 5 aa, Artificial Sequence
  Description of Artificial Sequence: Synthetic peptide
GSLTQ

SEQ ID NO: 4377 - protein, 5 aa, Artificial Sequence
  Description of Artificial Sequence: Synthetic peptide
GVLRG

SEQ ID NO: 4378 - protein, 5 aa, Artificial Sequence
  Description of Artificial Sequence: Synthetic peptide
HPLAV

SEQ ID NO: 4379 - protein, 5 aa, Artificial Sequence
  Description of Artificial Sequence: Synthetic peptide
HTLGM

SEQ ID NO: 4380 - protein, 5 aa, Artificial Sequence
  Description of Artificial Sequence: Synthetic peptide
IQLGG

SEQ ID NO: 4381 - protein, 5 aa, Artificial Sequence
  Description of Artificial Sequence: Synthetic peptide
KLLGD

SEQ ID NO: 4382 - protein, 5 aa, Artificial Sequence
  Description of Artificial Sequence: Synthetic peptide
MALAR

SEQ ID NO: 4383 - protein, 5 aa, Artificial Sequence
  Description of Artificial Sequence: Synthetic peptide
MELEP

SEQ ID NO: 4384 - protein, 5 aa, Artificial Sequence
  Description of Artificial Sequence: Synthetic peptide
MGLAN

SEQ ID NO: 4385 - protein, 5 aa, Artificial Sequence
  Description of Artificial Sequence: Synthetic peptide
MPLDG

SEQ ID NO: 4386 - protein, 5 aa, Artificial Sequence
  Description of Artificial Sequence: Synthetic peptide
NVLGR

SEQ ID NO: 4387 - protein, 5 aa, Artificial Sequence
  Description of Artificial Sequence: Synthetic peptide
PGLPE

SEQ ID NO: 4388 - protein, 5 aa, Artificial Sequence
  Description of Artificial Sequence: Synthetic peptide
PHLQN

SEQ ID NO: 4389 - protein, 5 aa, Artificial Sequence
  Description of Artificial Sequence: Synthetic peptide
PRLGS

SEQ ID NO: 4390 - protein, 5 aa, Artificial Sequence
  Description of Artificial Sequence: Synthetic peptide
PSLLV

SEQ ID NO: 4391 - protein, 5 aa, Artificial Sequence
  Description of Artificial Sequence: Synthetic peptide
PTLAR

SEQ ID NO: 4392 - protein, 5 aa, Artificial Sequence
  Description of Artificial Sequence: Synthetic peptide
QMLER

SEQ ID NO: 4393 - protein, 5 aa, Artificial Sequence
  Description of Artificial Sequence: Synthetic peptide
RDLGS

SEQ ID NO: 4394 - protein, 5 aa, Artificial Sequence
  Description of Artificial Sequence: Synthetic peptide
RGLGN

SEQ ID NO: 4395 - protein, 5 aa, Artificial Sequence
  Description of Artificial Sequence: Synthetic peptide
RLLEK

SEQ ID NO: 4396 - protein, 5 aa, Artificial Sequence
  Description of Artificial Sequence: Synthetic peptide
SVLSG

SEQ ID NO: 4397 - protein, 5 aa, Artificial Sequence
  Description of Artificial Sequence: Synthetic peptide
TGLVN

SEQ ID NO: 4398 - protein, 5 aa, Artificial Sequence
  Description of Artificial Sequence: Synthetic peptide
TLASH

SEQ ID NO: 4399 - protein, 5 aa, Artificial Sequence
  Description of Artificial Sequence: Synthetic peptide
TRLHT

SEQ ID NO: 4400 - protein, 5 aa, Artificial Sequence
  Description of Artificial Sequence: Synthetic peptide
VVLAG

SEQ ID NO: 4401 - protein, 5 aa, Artificial Sequence
  Description of Artificial Sequence: Synthetic peptide
AGLVG

SEQ ID NO: 4402 - protein, 4 aa, Artificial Sequence
  Description of Artificial Sequence: Synthetic peptide
ARPS

SEQ ID NO: 4403 - protein, 5 aa, Artificial Sequence
  Description of Artificial Sequence: Synthetic peptide
DKLHR

SEQ ID NO: 4404 - protein, 5 aa, Artificial Sequence
  Description of Artificial Sequence: Synthetic peptide
ERLPV

SEQ ID NO: 4405 - protein, 5 aa, Artificial Sequence
  Description of Artificial Sequence: Synthetic peptide
GDLVE

SEQ ID NO: 4406 - protein, 5 aa, Artificial Sequence
  Description of Artificial Sequence: Synthetic peptide
GELGE

SEQ ID NO: 4407 - protein, 5 aa, Artificial Sequence
  Description of Artificial Sequence: Synthetic peptide
GGLMQ

SEQ ID NO: 4408 - protein, 4 aa, Artificial Sequence
  Description of Artificial Sequence: Synthetic peptide
GLLT

SEQ ID NO: 4409 - protein, 4 aa, Artificial Sequence
  Description of Artificial Sequence: Synthetic peptide
GLPG

SEQ ID NO: 4410 - protein, 5 aa, Artificial Sequence
  Description of Artificial Sequence: Synthetic peptide
GSLRT

SEQ ID NO: 4411 - protein, 5 aa, Artificial Sequence
  Description of Artificial Sequence: Synthetic peptide
GTLQV

SEQ ID NO: 4412 - protein, 5 aa, Artificial Sequence
  Description of Artificial Sequence: Synthetic peptide
GVLKS

SEQ ID NO: 4413 - protein, 5 aa, Artificial Sequence
  Description of Artificial Sequence: Synthetic peptide
HGLVN

SEQ ID NO: 4414 - protein, 5 aa, Artificial Sequence
  Description of Artificial Sequence: Synthetic peptide
IELGR

SEQ ID NO: 4415 - protein, 5 aa, Artificial Sequence
  Description of Artificial Sequence: Synthetic peptide
KPLEL

SEQ ID NO: 4416 - protein, 4 aa, Artificial Sequence
  Description of Artificial Sequence: Synthetic peptide
MKLE

SEQ ID NO: 4417 - protein, 5 aa, Artificial Sequence
  Description of Artificial Sequence: Synthetic peptide
PALMR

SEQ ID NO: 4418 - protein, 5 aa, Artificial Sequence
  Description of Artificial Sequence: Synthetic peptide
PPLVV

SEQ ID NO: 4419 - protein, 5 aa, Artificial Sequence
  Description of Artificial Sequence: Synthetic peptide
QALVP

SEQ ID NO: 4420 - protein, 5 aa, Artificial Sequence
  Description of Artificial Sequence: Synthetic peptide
QELGG

SEQ ID NO: 4421 - protein, 5 aa, Artificial Sequence
  Description of Artificial Sequence: Synthetic peptide
QTLGV

SEQ ID NO: 4422 - protein, 5 aa, Artificial Sequence
  Description of Artificial Sequence: Synthetic peptide
RILEP

SEQ ID NO: 4423 - protein, 5 aa, Artificial Sequence
  Description of Artificial Sequence: Synthetic peptide
RLLMN

SEQ ID NO: 4424 - protein, 5 aa, Artificial Sequence
  Description of Artificial Sequence: Synthetic peptide
RPLVG

SEQ ID NO: 4425 - protein, 5 aa, Artificial Sequence
  Description of Artificial Sequence: Synthetic peptide
RRLEP

SEQ ID NO: 4426 - protein, 5 aa, Artificial Sequence
  Description of Artificial Sequence: Synthetic peptide
SGLRA

SEQ ID NO: 4427 - protein, 5 aa, Artificial Sequence
  Description of Artificial Sequence: Synthetic peptide
SKLMA

SEQ ID NO: 4428 - protein, 5 aa, Artificial Sequence
  Description of Artificial Sequence: Synthetic peptide
TMLEP

SEQ ID NO: 4429 - protein, 4 aa, Artificial Sequence
  Description of Artificial Sequence: Synthetic peptide
TRSQ

SEQ ID NO: 4430 - protein, 5 aa, Artificial Sequence
  Description of Artificial Sequence: Synthetic peptide
VALRK

SEQ ID NO: 4431 - protein, 5 aa, Artificial Sequence
  Description of Artificial Sequence: Synthetic peptide
VDLSG

SEQ ID NO: 4432 - protein, 5 aa, Artificial Sequence
  Description of Artificial Sequence: Synthetic peptide
VMLLG

SEQ ID NO: 4433 - protein, 5 aa, Artificial Sequence
  Description of Artificial Sequence: Synthetic peptide
VPLSE

SEQ ID NO: 4434 - protein, 5 aa, Artificial Sequence
  Description of Artificial Sequence: Synthetic peptide
ARLPV

SEQ ID NO: 4435 - protein, 5 aa, Artificial Sequence
  Description of Artificial Sequence: Synthetic peptide
ARYGC

SEQ ID NO: 4436 - protein, 5 aa, Artificial Sequence
  Description of Artificial Sequence: Synthetic peptide
ERLLQ

SEQ ID NO: 4437 - protein, 5 aa, Artificial Sequence
  Description of Artificial Sequence: Synthetic peptide
ETLMG

SEQ ID NO: 4438 - protein, 5 aa, Artificial Sequence
  Description of Artificial Sequence: Synthetic peptide
GHLML

SEQ ID NO: 4439 - protein, 5 aa, Artificial Sequence
  Description of Artificial Sequence: Synthetic peptide
GHLQG

SEQ ID NO: 4440 - protein, 5 aa, Artificial Sequence
  Description of Artificial Sequence: Synthetic peptide
GKLMV

SEQ ID NO: 4441 - protein, 4 aa, Artificial Sequence
  Description of Artificial Sequence: Synthetic peptide
GPLG

SEQ ID NO: 4442 - protein, 5 aa, Artificial Sequence
  Description of Artificial Sequence: Synthetic peptide
GPLTM

SEQ ID NO: 4443 - protein, 4 aa, Artificial Sequence
  Description of Artificial Sequence: Synthetic peptide
GQLV

SEQ ID NO: 4444 - protein, 5 aa, Artificial Sequence
  Description of Artificial Sequence: Synthetic peptide
GSLTL

SEQ ID NO: 4445 - protein, 5 aa, Artificial Sequence
  Description of Artificial Sequence: Synthetic peptide
GTLRA

SEQ ID NO: 4446 - protein, 5 aa, Artificial Sequence
  Description of Artificial Sequence: Synthetic peptide
GTLTG

SEQ ID NO: 4447 - protein, 5 aa, Artificial Sequence
  Description of Artificial Sequence: Synthetic peptide
IVLVR

SEQ ID NO: 4448 - protein, 5 aa, Artificial Sequence
  Description of Artificial Sequence: Synthetic peptide
MALVR

SEQ ID NO: 4449 - protein, 5 aa, Artificial Sequence
  Description of Artificial Sequence: Synthetic peptide
MELGK

SEQ ID NO: 4450 - protein, 5 aa, Artificial Sequence
  Description of Artificial Sequence: Synthetic peptide
MGLEG

SEQ ID NO: 4451 - protein, 5 aa, Artificial Sequence
  Description of Artificial Sequence: Synthetic peptide
MGLMA

SEQ ID NO: 4452 - protein, 5 aa, Artificial Sequence
  Description of Artificial Sequence: Synthetic peptide
MPLNR

SEQ ID NO: 4453 - protein, 5 aa, Artificial Sequence
  Description of Artificial Sequence: Synthetic peptide
NMLGG

SEQ ID NO: 4454 - protein, 5 aa, Artificial Sequence
  Description of Artificial Sequence: Synthetic peptide
NPLEL

SEQ ID NO: 4455 - protein, 5 aa, Artificial Sequence
  Description of Artificial Sequence: Synthetic peptide
NSLGG

SEQ ID NO: 4456 - protein, 5 aa, Artificial Sequence
  Description of Artificial Sequence: Synthetic peptide
PRLLQ

SEQ ID NO: 4457 - protein, 5 aa, Artificial Sequence
  Description of Artificial Sequence: Synthetic peptide
PRLVK

SEQ ID NO: 4458 - protein, 5 aa, Artificial Sequence
  Description of Artificial Sequence: Synthetic peptide
RHLRS

SEQ ID NO: 4459 - protein, 5 aa, Artificial Sequence
  Description of Artificial Sequence: Synthetic peptide
RSLVV

SEQ ID NO: 4460 - protein, 12 aa, Artificial Sequence
  Description of Artificial Sequence: Synthetic peptide
RSPVERMWILRA

SEQ ID NO: 4461 - protein, 5 aa, Artificial Sequence
  Description of Artificial Sequence: Synthetic peptide
RTLNA

SEQ ID NO: 4462 - protein, 4 aa, Artificial Sequence
  Description of Artificial Sequence: Synthetic peptide
TELN

SEQ ID NO: 4463 - protein, 5 aa, Artificial Sequence
  Description of Artificial Sequence: Synthetic peptide
VKLRA

SEQ ID NO: 4464 - protein, 5 aa, Artificial Sequence
  Description of Artificial Sequence: Synthetic peptide
VLLQD

SEQ ID NO: 4465 - protein, 4 aa, Artificial Sequence
  Description of Artificial Sequence: Synthetic peptide
VMLG

SEQ ID NO: 4466 - protein, 5 aa, Artificial Sequence
  Description of Artificial Sequence: Synthetic peptide
AGLNG

SEQ ID NO: 4467 - protein, 5 aa, Artificial Sequence
  Description of Artificial Sequence: Synthetic peptide
AHLRM

SEQ ID NO: 4468 - protein, 4 aa, Artificial Sequence
  Description of Artificial Sequence: Synthetic peptide
ARRA

SEQ ID NO: 4469 - protein, 5 aa, Artificial Sequence
  Description of Artificial Sequence: Synthetic peptide
ARLPE

SEQ ID NO: 4470 - protein, 5 aa, Artificial Sequence
  Description of Artificial Sequence: Synthetic peptide
AVLNK

SEQ ID NO: 4471 - protein, 14 aa, Artificial Sequence
  Description of Artificial Sequence: Synthetic peptide
DALQYESECGGLNH

SEQ ID NO: 4472 - protein, 5 aa, Artificial Sequence
  Description of Artificial Sequence: Synthetic peptide
EGLRD

SEQ ID NO: 4473 - protein, 5 aa, Artificial Sequence
  Description of Artificial Sequence: Synthetic peptide
ESLMG

SEQ ID NO: 4474 - protein, 4 aa, Artificial Sequence
  Description of Artificial Sequence: Synthetic peptide
GELV

SEQ ID NO: 4475 - protein, 5 aa, Artificial Sequence
  Description of Artificial Sequence: Synthetic peptide
GGLRP

SEQ ID NO: 4476 - protein, 4 aa, Artificial Sequence
  Description of Artificial Sequence: Synthetic peptide
GLIG

SEQ ID NO: 4477 - protein, 4 aa, Artificial Sequence
  Description of Artificial Sequence: Synthetic peptide
GLIS

SEQ ID NO: 4478 - protein, 5 aa, Artificial Sequence
  Description of Artificial Sequence: Synthetic peptide
GLLGN

SEQ ID NO: 4479 - protein, 5 aa, Artificial Sequence
  Description of Artificial Sequence: Synthetic peptide
GMLVN

SEQ ID NO: 4480 - protein, 5 aa, Artificial Sequence
  Description of Artificial Sequence: Synthetic peptide
GPLED

SEQ ID NO: 4481 - protein, 5 aa, Artificial Sequence
  Description of Artificial Sequence: Synthetic peptide
GPLQA

SEQ ID NO: 4482 - protein, 5 aa, Artificial Sequence
  Description of Artificial Sequence: Synthetic peptide
GTLTV

SEQ ID NO: 4483 - protein, 5 aa, Artificial Sequence
  Description of Artificial Sequence: Synthetic peptide
GVLGI

SEQ ID NO: 4484 - protein, 5 aa, Artificial Sequence
  Description of Artificial Sequence: Synthetic peptide
IDLGM

SEQ ID NO: 4485 - protein, 5 aa, Artificial Sequence
  Description of Artificial Sequence: Synthetic peptide
IELGG

SEQ ID NO: 4486 - protein, 5 aa, Artificial Sequence
  Description of Artificial Sequence: Synthetic peptide
IGLAT

SEQ ID NO: 4487 - protein, 5 aa, Artificial Sequence
  Description of Artificial Sequence: Synthetic peptide
KKLMP

SEQ ID NO: 4488 - protein, 5 aa, Artificial Sequence
  Description of Artificial Sequence: Synthetic peptide
KLLGE

SEQ ID NO: 4489 - protein, 5 aa, Artificial Sequence
  Description of Artificial Sequence: Synthetic peptide
KLLLG

SEQ ID NO: 4490 - protein, 5 aa, Artificial Sequence
  Description of Artificial Sequence: Synthetic peptide
MGLTL

SEQ ID NO: 4491 - protein, 5 aa, Artificial Sequence
  Description of Artificial Sequence: Synthetic peptide
MNLGM

SEQ ID NO: 4492 - protein, 5 aa, Artificial Sequence
  Description of Artificial Sequence: Synthetic peptide
MPLMV

SEQ ID NO: 4493 - protein, 5 aa, Artificial Sequence
  Description of Artificial Sequence: Synthetic peptide
PALTV

SEQ ID NO: 4494 - protein, 5 aa, Artificial Sequence
  Description of Artificial Sequence: Synthetic peptide
PGLAL

SEQ ID NO: 4495 - protein, 5 aa, Artificial Sequence
  Description of Artificial Sequence: Synthetic peptide
PGLMG

SEQ ID NO: 4496 - protein, 5 aa, Artificial Sequence
  Description of Artificial Sequence: Synthetic peptide
PHLMS

SEQ ID NO: 4497 - protein, 5 aa, Artificial Sequence
  Description of Artificial Sequence: Synthetic peptide
PQLSA

SEQ ID NO: 4498 - protein, 5 aa, Artificial Sequence
  Description of Artificial Sequence: Synthetic peptide
PRLKA

SEQ ID NO: 4499 - protein, 5 aa, Artificial Sequence
  Description of Artificial Sequence: Synthetic peptide
QKLIR

SEQ ID NO: 4500 - protein, 5 aa, Artificial Sequence
  Description of Artificial Sequence: Synthetic peptide
RELGV

SEQ ID NO: 4501 - protein, 5 aa, Artificial Sequence
  Description of Artificial Sequence: Synthetic peptide
RGLHQ

SEQ ID NO: 4502 - protein, 5 aa, Artificial Sequence
  Description of Artificial Sequence: Synthetic peptide
RGLIG

SEQ ID NO: 4503 - protein, 5 aa, Artificial Sequence
  Description of Artificial Sequence: Synthetic peptide
RGLMG

SEQ ID NO: 4504 - protein, 5 aa, Artificial Sequence
  Description of Artificial Sequence: Synthetic peptide
RTRSH

SEQ ID NO: 4505 - protein, 5 aa, Artificial Sequence
  Description of Artificial Sequence: Synthetic peptide
SQLDT

SEQ ID NO: 4506 - protein, 5 aa, Artificial Sequence
  Description of Artificial Sequence: Synthetic peptide
TELGG

SEQ ID NO: 4507 - protein, 5 aa, Artificial Sequence
  Description of Artificial Sequence: Synthetic peptide
TKLGV

SEQ ID NO: 4508 - protein, 5 aa, Artificial Sequence
  Description of Artificial Sequence: Synthetic peptide
TMLEG

SEQ ID NO: 4509 - protein, 5 aa, Artificial Sequence
  Description of Artificial Sequence: Synthetic peptide
VSLGV

SEQ ID NO: 4510 - protein, 5 aa, Artificial Sequence
  Description of Artificial Sequence: Synthetic peptide
VSLTA

SEQ ID NO: 4511 - protein, 5 aa, Artificial Sequence
  Description of Artificial Sequence: Synthetic peptide
VSLVG

SEQ ID NO: 4512 - protein, 5 aa, Artificial Sequence
  Description of Artificial Sequence: Synthetic peptide
AGLQN

SEQ ID NO: 4513 - protein, 5 aa, Artificial Sequence
  Description of Artificial Sequence: Synthetic peptide
AGLRV

SEQ ID NO: 4514 - protein, 5 aa, Artificial Sequence
  Description of Artificial Sequence: Synthetic peptide
ARLRT

SEQ ID NO: 4515 - protein, 5 aa, Artificial Sequence
  Description of Artificial Sequence: Synthetic peptide
ASLQK

SEQ ID NO: 4516 - protein, 4 aa, Artificial Sequence
  Description of Artificial Sequence: Synthetic peptide
ASLR

SEQ ID NO: 4517 - protein, 5 aa, Artificial Sequence
  Description of Artificial Sequence: Synthetic peptide
DILGE

SEQ ID NO: 4518 - protein, 5 aa, Artificial Sequence
  Description of Artificial Sequence: Synthetic peptide
EELRM

SEQ ID NO: 4519 - protein, 5 aa, Artificial Sequence
  Description of Artificial Sequence: Synthetic peptide
EGLTG

SEQ ID NO: 4520 - protein, 5 aa, Artificial Sequence
  Description of Artificial Sequence: Synthetic peptide
EMLKE

SEQ ID NO: 4521 - protein, 5 aa, Artificial Sequence
  Description of Artificial Sequence: Synthetic peptide
ESLLG

SEQ ID NO: 4522 - protein, 5 aa, Artificial Sequence
  Description of Artificial Sequence: Synthetic peptide
ETLAG

SEQ ID NO: 4523 - protein, 5 aa, Artificial Sequence
  Description of Artificial Sequence: Synthetic peptide
EVLVQ

SEQ ID NO: 4524 - protein, 5 aa, Artificial Sequence
  Description of Artificial Sequence: Synthetic peptide
GKLRS

SEQ ID NO: 4525 - protein, 4 aa, Artificial Sequence
  Description of Artificial Sequence: Synthetic peptide
GLKT

SEQ ID NO: 4526 - protein, 5 aa, Artificial Sequence
  Description of Artificial Sequence: Synthetic peptide
GLLGV

SEQ ID NO: 4527 - protein, 5 aa, Artificial Sequence
  Description of Artificial Sequence: Synthetic peptide
GMLLP

SEQ ID NO: 4528 - protein, 5 aa, Artificial Sequence
  Description of Artificial Sequence: Synthetic peptide
GMLSG

SEQ ID NO: 4529 - protein, 5 aa, Artificial Sequence
  Description of Artificial Sequence: Synthetic peptide
GRLAP

SEQ ID NO: 4530 - protein, 5 aa, Artificial Sequence
  Description of Artificial Sequence: Synthetic peptide
GSLLR

SEQ ID NO: 4531 - protein, 5 aa, Artificial Sequence
  Description of Artificial Sequence: Synthetic peptide
GTLTM

SEQ ID NO: 4532 - protein, 5 aa, Artificial Sequence
  Description of Artificial Sequence: Synthetic peptide
ILLQQ

SEQ ID NO: 4533 - protein, 5 aa, Artificial Sequence
  Description of Artificial Sequence: Synthetic peptide
KLLQM

SEQ ID NO: 4534 - protein, 5 aa, Artificial Sequence
  Description of Artificial Sequence: Synthetic peptide
LGLPG

SEQ ID NO: 4535 - protein, 5 aa, Artificial Sequence
  Description of Artificial Sequence: Synthetic peptide
MELVL

SEQ ID NO: 4536 - protein, 5 aa, Artificial Sequence
  Description of Artificial Sequence: Synthetic peptide
MGLAG

SEQ ID NO: 4537 - protein, 5 aa, Artificial Sequence
  Description of Artificial Sequence: Synthetic peptide
MGLPV

SEQ ID NO: 4538 - protein, 5 aa, Artificial Sequence
  Description of Artificial Sequence: Synthetic peptide
MQLAD

SEQ ID NO: 4539 - protein, 5 aa, Artificial Sequence
  Description of Artificial Sequence: Synthetic peptide
MSLLR

SEQ ID NO: 4540 - protein, 5 aa, Artificial Sequence
  Description of Artificial Sequence: Synthetic peptide
MSLPE

SEQ ID NO: 4541 - protein, 5 aa, Artificial Sequence
  Description of Artificial Sequence: Synthetic peptide
NGLKQ

SEQ ID NO: 4542 - protein, 7 aa, Artificial Sequence
  Description of Artificial Sequence: Synthetic peptide
NGRSPVE

SEQ ID NO: 4543 - protein, 5 aa, Artificial Sequence
  Description of Artificial Sequence: Synthetic peptide
NPLSR

SEQ ID NO: 4544 - protein, 5 aa, Artificial Sequence
  Description of Artificial Sequence: Synthetic peptide
NQLVA

SEQ ID NO: 4545 - protein, 5 aa, Artificial Sequence
  Description of Artificial Sequence: Synthetic peptide
NTLGL

SEQ ID NO: 4546 - protein, 5 aa, Artificial Sequence
  Description of Artificial Sequence: Synthetic peptide
PRLRV

SEQ ID NO: 4547 - protein, 5 aa, Artificial Sequence
  Description of Artificial Sequence: Synthetic peptide
PVLLM

SEQ ID NO: 4548 - protein, 5 aa, Artificial Sequence
  Description of Artificial Sequence: Synthetic peptide
PVLTG

SEQ ID NO: 4549 - protein, 4 aa, Artificial Sequence
  Description of Artificial Sequence: Synthetic peptide
QQLL

SEQ ID NO: 4550 - protein, 5 aa, Artificial Sequence
  Description of Artificial Sequence: Synthetic peptide
RGLVN

SEQ ID NO: 4551 - protein, 5 aa, Artificial Sequence
  Description of Artificial Sequence: Synthetic peptide
RHLVV

SEQ ID NO: 4552 - protein, 5 aa, Artificial Sequence
  Description of Artificial Sequence: Synthetic peptide
RLLAE

SEQ ID NO: 4553 - protein, 5 aa, Artificial Sequence
  Description of Artificial Sequence: Synthetic peptide
RLLPG

SEQ ID NO: 4554 - protein, 5 aa, Artificial Sequence
  Description of Artificial Sequence: Synthetic peptide
RPLIT

SEQ ID NO: 4555 - protein, 5 aa, Artificial Sequence
  Description of Artificial Sequence: Synthetic peptide
RVLMN

SEQ ID NO: 4556 - protein, 5 aa, Artificial Sequence
  Description of Artificial Sequence: Synthetic peptide
RVLQR

SEQ ID NO: 4557 - protein, 5 aa, Artificial Sequence
  Description of Artificial Sequence: Synthetic peptide
TLLPG

SEQ ID NO: 4558 - protein, 5 aa, Artificial Sequence
  Description of Artificial Sequence: Synthetic peptide
VGLPA

SEQ ID NO: 4559 - protein, 5 aa, Artificial Sequence
  Description of Artificial Sequence: Synthetic peptide
VPLRP

SEQ ID NO: 4560 - protein, 5 aa, Artificial Sequence
  Description of Artificial Sequence: Synthetic peptide
VRLMP

SEQ ID NO: 4561 - protein, 5 aa, Artificial Sequence
  Description of Artificial Sequence: Synthetic peptide
VSLGE

SEQ ID NO: 4562 - protein, 5 aa, Artificial Sequence
  Description of Artificial Sequence: Synthetic peptide
AALTK

SEQ ID NO: 4563 - protein, 5 aa, Artificial Sequence
  Description of Artificial Sequence: Synthetic peptide
AALVK

SEQ ID NO: 4564 - protein, 5 aa, Artificial Sequence
  Description of Artificial Sequence: Synthetic peptide
AHLTP

SEQ ID NO: 4565 - protein, 5 aa, Artificial Sequence
  Description of Artificial Sequence: Synthetic peptide
AILRT

SEQ ID NO: 4566 - protein, 5 aa, Artificial Sequence
  Description of Artificial Sequence: Synthetic peptide
AKLNS

SEQ ID NO: 4567 - protein, 5 aa, Artificial Sequence
  Description of Artificial Sequence: Synthetic peptide
ALLGA

SEQ ID NO: 4568 - protein, 5 aa, Artificial Sequence
  Description of Artificial Sequence: Synthetic peptide
ARLLR

SEQ ID NO: 4569 - protein, 4 aa, Artificial Sequence
  Description of Artificial Sequence: Synthetic peptide
DVLG

SEQ ID NO: 4570 - protein, 5 aa, Artificial Sequence
  Description of Artificial Sequence: Synthetic peptide
EELQS

SEQ ID NO: 4571 - protein, 5 aa, Artificial Sequence
  Description of Artificial Sequence: Synthetic peptide
ELLGP

SEQ ID NO: 4572 - protein, 4 aa, Artificial Sequence
  Description of Artificial Sequence: Synthetic peptide
ERMC

SEQ ID NO: 4573 - protein, 5 aa, Artificial Sequence
  Description of Artificial Sequence: Synthetic peptide
EVLAG

SEQ ID NO: 4574 - protein, 5 aa, Artificial Sequence
  Description of Artificial Sequence: Synthetic peptide
GALGE

SEQ ID NO: 4575 - protein, 5 aa, Artificial Sequence
  Description of Artificial Sequence: Synthetic peptide
GDLVP

SEQ ID NO: 4576 - protein, 5 aa, Artificial Sequence
  Description of Artificial Sequence: Synthetic peptide
GELRI

SEQ ID NO: 4577 - protein, 5 aa, Artificial Sequence
  Description of Artificial Sequence: Synthetic peptide
GGLEL

SEQ ID NO: 4578 - protein, 5 aa, Artificial Sequence
  Description of Artificial Sequence: Synthetic peptide
GHLSP

SEQ ID NO: 4579 - protein, 5 aa, Artificial Sequence
  Description of Artificial Sequence: Synthetic peptide
GKLEA

SEQ ID NO: 4580 - protein, 5 aa, Artificial Sequence
  Description of Artificial Sequence: Synthetic peptide
GKLKR

SEQ ID NO: 4581 - protein, 5 aa, Artificial Sequence
  Description of Artificial Sequence: Synthetic peptide
GKLVI

SEQ ID NO: 4582 - protein, 4 aa, Artificial Sequence
  Description of Artificial Sequence: Synthetic peptide
GLHQ

SEQ ID NO: 4583 - protein, 4 aa, Artificial Sequence
  Description of Artificial Sequence: Synthetic peptide
GLLR

SEQ ID NO: 4584 - protein, 4 aa, Artificial Sequence
  Description of Artificial Sequence: Synthetic peptide
GLMV

SEQ ID NO: 4585 - protein, 4 aa, Artificial Sequence
  Description of Artificial Sequence: Synthetic peptide
GLTL

SEQ ID NO: 4586 - protein, 5 aa, Artificial Sequence
  Description of Artificial Sequence: Synthetic peptide
GPLVG

SEQ ID NO: 4587 - protein, 5 aa, Artificial Sequence
  Description of Artificial Sequence: Synthetic peptide
GQLVD

SEQ ID NO: 4588 - protein, 5 aa, Artificial Sequence
  Description of Artificial Sequence: Synthetic peptide
GRLSV

SEQ ID NO: 4589 - protein, 5 aa, Artificial Sequence
  Description of Artificial Sequence: Synthetic peptide
GVLAV

SEQ ID NO: 4590 - protein, 5 aa, Artificial Sequence
  Description of Artificial Sequence: Synthetic peptide
HVLEL

SEQ ID NO: 4591 - protein, 5 aa, Artificial Sequence
  Description of Artificial Sequence: Synthetic peptide
IELEM

SEQ ID NO: 4592 - protein, 5 aa, Artificial Sequence
  Description of Artificial Sequence: Synthetic peptide
IGLQA

SEQ ID NO: 4593 - protein, 5 aa, Artificial Sequence
  Description of Artificial Sequence: Synthetic peptide
KGLGN

SEQ ID NO: 4594 - protein, 5 aa, Artificial Sequence
  Description of Artificial Sequence: Synthetic peptide
KILPV

SEQ ID NO: 4595 - protein, 5 aa, Artificial Sequence
  Description of Artificial Sequence: Synthetic peptide
KPLPG

SEQ ID NO: 4596 - protein, 5 aa, Artificial Sequence
  Description of Artificial Sequence: Synthetic peptide
KSLRM

SEQ ID NO: 4597 - protein, 5 aa, Artificial Sequence
  Description of Artificial Sequence: Synthetic peptide
KTLGT

SEQ ID NO: 4598 - protein, 5 aa, Artificial Sequence
  Description of Artificial Sequence: Synthetic peptide
LGLAA

SEQ ID NO: 4599 - protein, 5 aa, Artificial Sequence
  Description of Artificial Sequence: Synthetic peptide
LGLGG

SEQ ID NO: 4600 - protein, 5 aa, Artificial Sequence
  Description of Artificial Sequence: Synthetic peptide
LVLQE

SEQ ID NO: 4601 - protein, 5 aa, Artificial Sequence
  Description of Artificial Sequence: Synthetic peptide
MGLAS

SEQ ID NO: 4602 - protein, 5 aa, Artificial Sequence
  Description of Artificial Sequence: Synthetic peptide
MLLEE

SEQ ID NO: 4603 - protein, 5 aa, Artificial Sequence
  Description of Artificial Sequence: Synthetic peptide
MSLRQ

SEQ ID NO: 4604 - protein, 5 aa, Artificial Sequence
  Description of Artificial Sequence: Synthetic peptide
MTLGT

SEQ ID NO: 4605 - protein, 5 aa, Artificial Sequence
  Description of Artificial Sequence: Synthetic peptide
NGLIV

SEQ ID NO: 4606 - protein, 5 aa, Artificial Sequence
  Description of Artificial Sequence: Synthetic peptide
NHLRM

SEQ ID NO: 4607 - protein, 5 aa, Artificial Sequence
  Description of Artificial Sequence: Synthetic peptide
PALIM

SEQ ID NO: 4608 - protein, 5 aa, Artificial Sequence
  Description of Artificial Sequence: Synthetic peptide
PGLAG

SEQ ID NO: 4609 - protein, 5 aa, Artificial Sequence
  Description of Artificial Sequence: Synthetic peptide
PLLRA

SEQ ID NO: 4610 - protein, 5 aa, Artificial Sequence
  Description of Artificial Sequence: Synthetic peptide
PPLDG

SEQ ID NO: 4611 - protein, 5 aa, Artificial Sequence
  Description of Artificial Sequence: Synthetic peptide
PPLIM

SEQ ID NO: 4612 - protein, 5 aa, Artificial Sequence
  Description of Artificial Sequence: Synthetic peptide
PPLLG

SEQ ID NO: 4613 - protein, 5 aa, Artificial Sequence
  Description of Artificial Sequence: Synthetic peptide
PQLTE

SEQ ID NO: 4614 - protein, 5 aa, Artificial Sequence
  Description of Artificial Sequence: Synthetic peptide
PVLDG

SEQ ID NO: 4615 - protein, 5 aa, Artificial Sequence
  Description of Artificial Sequence: Synthetic peptide
QGLTT

SEQ ID NO: 4616 - protein, 5 aa, Artificial Sequence
  Description of Artificial Sequence: Synthetic peptide
QRLAV

SEQ ID NO: 4617 - protein, 5 aa, Artificial Sequence
  Description of Artificial Sequence: Synthetic peptide
RELGG

SEQ ID NO: 4618 - protein, 5 aa, Artificial Sequence
  Description of Artificial Sequence: Synthetic peptide
RGLDG

SEQ ID NO: 4619 - protein, 5 aa, Artificial Sequence
  Description of Artificial Sequence: Synthetic peptide
RGLTE

SEQ ID NO: 4620 - protein, 5 aa, Artificial Sequence
  Description of Artificial Sequence: Synthetic peptide
RHLGA

SEQ ID NO: 4621 - protein, 5 aa, Artificial Sequence
  Description of Artificial Sequence: Synthetic peptide
RSLMI

SEQ ID NO: 4622 - protein, 5 aa, Artificial Sequence
  Description of Artificial Sequence: Synthetic peptide
RSLRP

SEQ ID NO: 4623 - protein, 5 aa, Artificial Sequence
  Description of Artificial Sequence: Synthetic peptide
SKLGE

SEQ ID NO: 4624 - protein, 4 aa, Artificial Sequence
  Description of Artificial Sequence: Synthetic peptide
THLR

SEQ ID NO: 4625 - protein, 5 aa, Artificial Sequence
  Description of Artificial Sequence: Synthetic peptide
TRLPP

SEQ ID NO: 4626 - protein, 5 aa, Artificial Sequence
  Description of Artificial Sequence: Synthetic peptide
VELGD

SEQ ID NO: 4627 - protein, 5 aa, Artificial Sequence
  Description of Artificial Sequence: Synthetic peptide
VGLKD

SEQ ID NO: 4628 - protein, 5 aa, Artificial Sequence
  Description of Artificial Sequence: Synthetic peptide
VKLHV

SEQ ID NO: 4629 - protein, 5 aa, Artificial Sequence
  Description of Artificial Sequence: Synthetic peptide
VKLLS

SEQ ID NO: 4630 - protein, 5 aa, Artificial Sequence
  Description of Artificial Sequence: Synthetic peptide
VQLTK

SEQ ID NO: 4631 - protein, 4 aa, Artificial Sequence
  Description of Artificial Sequence: Synthetic peptide
VRLK

SEQ ID NO: 4632 - protein, 5 aa, Artificial Sequence
  Description of Artificial Sequence: Synthetic peptide
VRLPP

SEQ ID NO: 4633 - protein, 5 aa, Artificial Sequence
  Description of Artificial Sequence: Synthetic peptide
AALEN

SEQ ID NO: 4634 - protein, 5 aa, Artificial Sequence
  Description of Artificial Sequence: Synthetic peptide
AALGP

SEQ ID NO: 4635 - protein, 5 aa, Artificial Sequence
  Description of Artificial Sequence: Synthetic peptide
AALGT

SEQ ID NO: 4636 - protein, 5 aa, Artificial Sequence
  Description of Artificial Sequence: Synthetic peptide
AALKI

SEQ ID NO: 4637 - protein, 5 aa, Artificial Sequence
  Description of Artificial Sequence: Synthetic peptide
AALMN

SEQ ID NO: 4638 - protein, 5 aa, Artificial Sequence
  Description of Artificial Sequence: Synthetic peptide
AALMQ

SEQ ID NO: 4639 - protein, 5 aa, Artificial Sequence
  Description of Artificial Sequence: Synthetic peptide
AALRV

SEQ ID NO: 4640 - protein, 5 aa, Artificial Sequence
  Description of Artificial Sequence: Synthetic peptide
AALSS

SEQ ID NO: 4641 - protein, 5 aa, Artificial Sequence
  Description of Artificial Sequence: Synthetic peptide
AELGP

SEQ ID NO: 4642 - protein, 5 aa, Artificial Sequence
  Description of Artificial Sequence: Synthetic peptide
AELRA

SEQ ID NO: 4643 - protein, 5 aa, Artificial Sequence
  Description of Artificial Sequence: Synthetic peptide
AGIAA

SEQ ID NO: 4644 - protein, 5 aa, Artificial Sequence
  Description of Artificial Sequence: Synthetic peptide
AGILQ

SEQ ID NO: 4645 - protein, 5 aa, Artificial Sequence
  Description of Artificial Sequence: Synthetic peptide
AGLDS

SEQ ID NO: 4646 - protein, 4 aa, Artificial Sequence
  Description of Artificial Sequence: Synthetic peptide
AGLG

SEQ ID NO: 4647 - protein, 5 aa, Artificial Sequence
  Description of Artificial Sequence: Synthetic peptide
AGLGG

SEQ ID NO: 4648 - protein, 5 aa, Artificial Sequence
  Description of Artificial Sequence: Synthetic peptide
AGLGN

SEQ ID NO: 4649 - protein, 5 aa, Artificial Sequence
  Description of Artificial Sequence: Synthetic peptide
AGLGP

SEQ ID NO: 4650 - protein, 5 aa, Artificial Sequence
  Description of Artificial Sequence: Synthetic peptide
AGLGQ

SEQ ID NO: 4651 - protein, 5 aa, Artificial Sequence
  Description of Artificial Sequence: Synthetic peptide
AHFRV

SEQ ID NO: 4652 - protein, 5 aa, Artificial Sequence
  Description of Artificial Sequence: Synthetic peptide
AHLRG

SEQ ID NO: 4653 - protein, 5 aa, Artificial Sequence
  Description of Artificial Sequence: Synthetic peptide
AHLRP

SEQ ID NO: 4654 - protein, 5 aa, Artificial Sequence
  Description of Artificial Sequence: Synthetic peptide
AKFRM

SEQ ID NO: 4655 - protein, 4 aa, Artificial Sequence
  Description of Artificial Sequence: Synthetic peptide
AKLE

SEQ ID NO: 4656 - protein, 5 aa, Artificial Sequence
  Description of Artificial Sequence: Synthetic peptide
AKLGE

SEQ ID NO: 4657 - protein, 5 aa, Artificial Sequence
  Description of Artificial Sequence: Synthetic peptide
AKLGL

SEQ ID NO: 4658 - protein, 5 aa, Artificial Sequence
  Description of Artificial Sequence: Synthetic peptide
AKLHA

SEQ ID NO: 4659 - protein, 5 aa, Artificial Sequence
  Description of Artificial Sequence: Synthetic peptide
AKLLG

SEQ ID NO: 4660 - protein, 5 aa, Artificial Sequence
  Description of Artificial Sequence: Synthetic peptide
AKLML

SEQ ID NO: 4661 - protein, 5 aa, Artificial Sequence
  Description of Artificial Sequence: Synthetic peptide
AKLQP

SEQ ID NO: 4662 - protein, 5 aa, Artificial Sequence
  Description of Artificial Sequence: Synthetic peptide
AKLRQ

SEQ ID NO: 4663 - protein, 4 aa, Artificial Sequence
  Description of Artificial Sequence: Synthetic peptide
AKLS

SEQ ID NO: 4664 - protein, 5 aa, Artificial Sequence
  Description of Artificial Sequence: Synthetic peptide
AKLTN

SEQ ID NO: 4665 - protein, 5 aa, Artificial Sequence
  Description of Artificial Sequence: Synthetic peptide
AKLWL

SEQ ID NO: 4666 - protein, 4 aa, Artificial Sequence
  Description of Artificial Sequence: Synthetic peptide
ALDA

SEQ ID NO: 4667 - protein, 4 aa, Artificial Sequence
  Description of Artificial Sequence: Synthetic peptide
ALIM

SEQ ID NO: 4668 - protein, 4 aa, Artificial Sequence
  Description of Artificial Sequence: Synthetic peptide
ALKG

SEQ ID NO: 4669 - protein, 5 aa, Artificial Sequence
  Description of Artificial Sequence: Synthetic peptide
ALLGE

SEQ ID NO: 4670 - protein, 5 aa, Artificial Sequence
  Description of Artificial Sequence: Synthetic peptide
ALLRS

SEQ ID NO: 4671 - protein, 4 aa, Artificial Sequence
  Description of Artificial Sequence: Synthetic peptide
ALTG

SEQ ID NO: 4672 - protein, 4 aa, Artificial Sequence
  Description of Artificial Sequence: Synthetic peptide
ALTR

SEQ ID NO: 4673 - protein, 5 aa, Artificial Sequence
  Description of Artificial Sequence: Synthetic peptide
AMLPD

SEQ ID NO: 4674 - protein, 4 aa, Artificial Sequence
  Description of Artificial Sequence: Synthetic peptide
AMLR

SEQ ID NO: 4675 - protein, 5 aa, Artificial Sequence
  Description of Artificial Sequence: Synthetic peptide
APLAG

SEQ ID NO: 4676 - protein, 5 aa, Artificial Sequence
  Description of Artificial Sequence: Synthetic peptide
APLGP

SEQ ID NO: 4677 - protein, 5 aa, Artificial Sequence
  Description of Artificial Sequence: Synthetic peptide
AQLAD

SEQ ID NO: 4678 - protein, 5 aa, Artificial Sequence
  Description of Artificial Sequence: Synthetic peptide
AQLLL

SEQ ID NO: 4679 - protein, 4 aa, Artificial Sequence
  Description of Artificial Sequence: Synthetic peptide
ARRG

SEQ ID NO: 4680 - protein, 5 aa, Artificial Sequence
  Description of Artificial Sequence: Synthetic peptide
ARLAA

SEQ ID NO: 4681 - protein, 5 aa, Artificial Sequence
  Description of Artificial Sequence: Synthetic peptide
ARLMS

SEQ ID NO: 4682 - protein, 5 aa, Artificial Sequence
  Description of Artificial Sequence: Synthetic peptide
ARLRS

SEQ ID NO: 4683 - protein, 5 aa, Artificial Sequence
  Description of Artificial Sequence: Synthetic peptide
ARLTE

SEQ ID NO: 4684 - protein, 5 aa, Artificial Sequence
  Description of Artificial Sequence: Synthetic peptide
ARYGR

SEQ ID NO: 4685 - protein, 5 aa, Artificial Sequence
  Description of Artificial Sequence: Synthetic peptide
ASLGP

SEQ ID NO: 4686 - protein, 5 aa, Artificial Sequence
  Description of Artificial Sequence: Synthetic peptide
ASLRP

SEQ ID NO: 4687 - protein, 4 aa, Artificial Sequence
  Description of Artificial Sequence: Synthetic peptide
ATRS

SEQ ID NO: 4688 - protein, 5 aa, Artificial Sequence
  Description of Artificial Sequence: Synthetic peptide
ATLAK

SEQ ID NO: 4689 - protein, 5 aa, Artificial Sequence
  Description of Artificial Sequence: Synthetic peptide
ATLEV

SEQ ID NO: 4690 - protein, 5 aa, Artificial Sequence
  Description of Artificial Sequence: Synthetic peptide
ATLKI

SEQ ID NO: 4691 - protein, 5 aa, Artificial Sequence
  Description of Artificial Sequence: Synthetic peptide
ATLMG

SEQ ID NO: 4692 - protein, 5 aa, Artificial Sequence
  Description of Artificial Sequence: Synthetic peptide
ATLNM

SEQ ID NO: 4693 - protein, 5 aa, Artificial Sequence
  Description of Artificial Sequence: Synthetic peptide
ATLNV

SEQ ID NO: 4694 - protein, 4 aa, Artificial Sequence
  Description of Artificial Sequence: Synthetic peptide
AVIG

SEQ ID NO: 4695 - protein, 5 aa, Artificial Sequence
  Description of Artificial Sequence: Synthetic peptide
CGLGR

SEQ ID NO: 4696 - protein, 5 aa, Artificial Sequence
  Description of Artificial Sequence: Synthetic peptide
DALQP

SEQ ID NO: 4697 - protein, 4 aa, Artificial Sequence
  Description of Artificial Sequence: Synthetic peptide
DELM

SEQ ID NO: 4698 - protein, 5 aa, Artificial Sequence
  Description of Artificial Sequence: Synthetic peptide
DELMN

SEQ ID NO: 4699 - protein, 5 aa, Artificial Sequence
  Description of Artificial Sequence: Synthetic peptide
DELRA

SEQ ID NO: 4700 - protein, 4 aa, Artificial Sequence
  Description of Artificial Sequence: Synthetic peptide
DGLE

SEQ ID NO: 4701 - protein, 5 aa, Artificial Sequence
  Description of Artificial Sequence: Synthetic peptide
DGLEK

SEQ ID NO: 4702 - protein, 5 aa, Artificial Sequence
  Description of Artificial Sequence: Synthetic peptide
DGLML

SEQ ID NO: 4703 - protein, 16 aa, Artificial Sequence
  Description of Artificial Sequence: Synthetic peptide
DGLTGHIRSHTGERPF

SEQ ID NO: 4704 - protein, 5 aa, Artificial Sequence
  Description of Artificial Sequence: Synthetic peptide
DGVAM

SEQ ID NO: 4705 - protein, 5 aa, Artificial Sequence
  Description of Artificial Sequence: Synthetic peptide
DHLVD

SEQ ID NO: 4706 - protein, 4 aa, Artificial Sequence
  Description of Artificial Sequence: Synthetic peptide
DILG

SEQ ID NO: 4707 - protein, 5 aa, Artificial Sequence
  Description of Artificial Sequence: Synthetic peptide
DILRT

SEQ ID NO: 4708 - protein, 5 aa, Artificial Sequence
  Description of Artificial Sequence: Synthetic peptide
DKLMM

SEQ ID NO: 4709 - protein, 4 aa, Artificial Sequence
  Description of Artificial Sequence: Synthetic peptide
DLLA

SEQ ID NO: 4710 - protein, 5 aa, Artificial Sequence
  Description of Artificial Sequence: Synthetic peptide
DLLAR

SEQ ID NO: 4711 - protein, 5 aa, Artificial Sequence
  Description of Artificial Sequence: Synthetic peptide
DRLAA

SEQ ID NO: 4712 - protein, 5 aa, Artificial Sequence
  Description of Artificial Sequence: Synthetic peptide
DRLGG

SEQ ID NO: 4713 - protein, 5 aa, Artificial Sequence
  Description of Artificial Sequence: Synthetic peptide
DSLPE

SEQ ID NO: 4714 - protein, 4 aa, Artificial Sequence
  Description of Artificial Sequence: Synthetic peptide
DSLV

SEQ ID NO: 4715 - protein, 5 aa, Artificial Sequence
  Description of Artificial Sequence: Synthetic peptide
DYLNV

SEQ ID NO: 4716 - protein, 4 aa, Artificial Sequence
  Description of Artificial Sequence: Synthetic peptide
EALA

SEQ ID NO: 4717 - protein, 5 aa, Artificial Sequence
  Description of Artificial Sequence: Synthetic peptide
EALKV

SEQ ID NO: 4718 - protein, 5 aa, Artificial Sequence
  Description of Artificial Sequence: Synthetic peptide
EALMV

SEQ ID NO: 4719 - protein, 5 aa, Artificial Sequence
  Description of Artificial Sequence: Synthetic peptide
EALTN

SEQ ID NO: 4720 - protein, 5 aa, Artificial Sequence
  Description of Artificial Sequence: Synthetic peptide
EELAP

SEQ ID NO: 4721 - protein, 16 aa, Artificial Sequence
  Description of Artificial Sequence: Synthetic peptide
EELMMHIRSHTGERPF

SEQ ID NO: 4722 - protein, 16 aa, Artificial Sequence
  Description of Artificial Sequence: Synthetic peptide
EELVEHIRSHTGERPF

SEQ ID NO: 4723 - protein, 5 aa, Artificial Sequence
  Description of Artificial Sequence: Synthetic peptide
EKLIV

SEQ ID NO: 4724 - protein, 5 aa, Artificial Sequence
  Description of Artificial Sequence: Synthetic peptide
ELLAR

SEQ ID NO: 4725 - protein, 5 aa, Artificial Sequence
  Description of Artificial Sequence: Synthetic peptide
ELLPS

SEQ ID NO: 4726 - protein, 5 aa, Artificial Sequence
  Description of Artificial Sequence: Synthetic peptide
EMLVA

SEQ ID NO: 4727 - protein, 5 aa, Artificial Sequence
  Description of Artificial Sequence: Synthetic peptide
EQLGT

SEQ ID NO: 4728 - protein, 5 aa, Artificial Sequence
  Description of Artificial Sequence: Synthetic peptide
ERLAV

SEQ ID NO: 4729 - protein, 5 aa, Artificial Sequence
  Description of Artificial Sequence: Synthetic peptide
ETLNS

SEQ ID NO: 4730 - protein, 5 aa, Artificial Sequence
  Description of Artificial Sequence: Synthetic peptide
ETSSH

SEQ ID NO: 4731 - protein, 5 aa, Artificial Sequence
  Description of Artificial Sequence: Synthetic peptide
EVLAV

SEQ ID NO: 4732 - protein, 5 aa, Artificial Sequence
  Description of Artificial Sequence: Synthetic peptide
EVLIQ

SEQ ID NO: 4733 - protein, 5 aa, Artificial Sequence
  Description of Artificial Sequence: Synthetic peptide
EVLQE

SEQ ID NO: 4734 - protein, 5 aa, Artificial Sequence
  Description of Artificial Sequence: Synthetic peptide
GALGL

SEQ ID NO: 4735 - protein, 5 aa, Artificial Sequence
  Description of Artificial Sequence: Synthetic peptide
GALGV

SEQ ID NO: 4736 - protein, 5 aa, Artificial Sequence
  Description of Artificial Sequence: Synthetic peptide
GALIS

SEQ ID NO: 4737 - protein, 5 aa, Artificial Sequence
  Description of Artificial Sequence: Synthetic peptide
GALMQ

SEQ ID NO: 4738 - protein, 5 aa, Artificial Sequence
  Description of Artificial Sequence: Synthetic peptide
GALRD

SEQ ID NO: 4739 - protein, 5 aa, Artificial Sequence
  Description of Artificial Sequence: Synthetic peptide
GALRG

SEQ ID NO: 4740 - protein, 5 aa, Artificial Sequence
  Description of Artificial Sequence: Synthetic peptide
GAVMN

SEQ ID NO: 4741 - protein, 4 aa, Artificial Sequence
  Description of Artificial Sequence: Synthetic peptide
GEGI

SEQ ID NO: 4742 - protein, 5 aa, Artificial Sequence
  Description of Artificial Sequence: Synthetic peptide
GELKV

SEQ ID NO: 4743 - protein, 5 aa, Artificial Sequence
  Description of Artificial Sequence: Synthetic peptide
GELML

SEQ ID NO: 4744 - protein, 5 aa, Artificial Sequence
  Description of Artificial Sequence: Synthetic peptide
GELMR

SEQ ID NO: 4745 - protein, 5 aa, Artificial Sequence
  Description of Artificial Sequence: Synthetic peptide
GELRV

SEQ ID NO: 4746 - protein, 5 aa, Artificial Sequence
  Description of Artificial Sequence: Synthetic peptide
GELTG

SEQ ID NO: 4747 - protein, 5 aa, Artificial Sequence
  Description of Artificial Sequence: Synthetic peptide
GFLAR

SEQ ID NO: 4748 - protein, 5 aa, Artificial Sequence
  Description of Artificial Sequence: Synthetic peptide
GGFRD

SEQ ID NO: 4749 - protein, 4 aa, Artificial Sequence
  Description of Artificial Sequence: Synthetic peptide
GGLA

SEQ ID NO: 4750 - protein, 5 aa, Artificial Sequence
  Description of Artificial Sequence: Synthetic peptide
GGLAE

SEQ ID NO: 4751 - protein, 5 aa, Artificial Sequence
  Description of Artificial Sequence: Synthetic peptide
GGLGE

SEQ ID NO: 4752 - protein, 5 aa, Artificial Sequence
  Description of Artificial Sequence: Synthetic peptide
GGLGP

SEQ ID NO: 4753 - protein, 5 aa, Artificial Sequence
  Description of Artificial Sequence: Synthetic peptide
GGLHP

SEQ ID NO: 4754 - protein, 5 aa, Artificial Sequence
  Description of Artificial Sequence: Synthetic peptide
GGLMD

SEQ ID NO: 4755 - protein, 5 aa, Artificial Sequence
  Description of Artificial Sequence: Synthetic peptide
GGLMT

SEQ ID NO: 4756 - protein, 5 aa, Artificial Sequence
  Description of Artificial Sequence: Synthetic peptide
GGLNI

SEQ ID NO: 4757 - protein, 5 aa, Artificial Sequence
  Description of Artificial Sequence: Synthetic peptide
GGLRL

SEQ ID NO: 4758 - protein, 5 aa, Artificial Sequence
  Description of Artificial Sequence: Synthetic peptide
GGLSG

SEQ ID NO: 4759 - protein, 5 aa, Artificial Sequence
  Description of Artificial Sequence: Synthetic peptide
GGLVG

SEQ ID NO: 4760 - protein, 5 aa, Artificial Sequence
  Description of Artificial Sequence: Synthetic peptide
GGVGL

SEQ ID NO: 4761 - protein, 5 aa, Artificial Sequence
  Description of Artificial Sequence: Synthetic peptide
GHLAI

SEQ ID NO: 4762 - protein, 5 aa, Artificial Sequence
  Description of Artificial Sequence: Synthetic peptide
GHLQC

SEQ ID NO: 4763 - protein, 5 aa, Artificial Sequence
  Description of Artificial Sequence: Synthetic peptide
GHLSV

SEQ ID NO: 4764 - protein, 5 aa, Artificial Sequence
  Description of Artificial Sequence: Synthetic peptide
GILAR

SEQ ID NO: 4765 - protein, 5 aa, Artificial Sequence
  Description of Artificial Sequence: Synthetic peptide
GILSG

SEQ ID NO: 4766 - protein, 5 aa, Artificial Sequence
  Description of Artificial Sequence: Synthetic peptide
GKLAI

SEQ ID NO: 4767 - protein, 5 aa, Artificial Sequence
  Description of Artificial Sequence: Synthetic peptide
GKLGG

SEQ ID NO: 4768 - protein, 5 aa, Artificial Sequence
  Description of Artificial Sequence: Synthetic peptide
GKLIG

SEQ ID NO: 4769 - protein, 5 aa, Artificial Sequence
  Description of Artificial Sequence: Synthetic peptide
GKLII

SEQ ID NO: 4770 - protein, 5 aa, Artificial Sequence
  Description of Artificial Sequence: Synthetic peptide
GKLIT

SEQ ID NO: 4771 - protein, 16 aa, Artificial Sequence
  Description of Artificial Sequence: Synthetic peptide
GKLKMHIRSHTGERPF

SEQ ID NO: 4772 - protein, 5 aa, Artificial Sequence
  Description of Artificial Sequence: Synthetic peptide
GKLLK

SEQ ID NO: 4773 - protein, 5 aa, Artificial Sequence
  Description of Artificial Sequence: Synthetic peptide
GKLNA

SEQ ID NO: 4774 - protein, 5 aa, Artificial Sequence
  Description of Artificial Sequence: Synthetic peptide
GKLPT

SEQ ID NO: 4775 - protein, 5 aa, Artificial Sequence
  Description of Artificial Sequence: Synthetic peptide
GKLQA

SEQ ID NO: 4776 - protein, 5 aa, Artificial Sequence
  Description of Artificial Sequence: Synthetic peptide
GKLRE

SEQ ID NO: 4777 - protein, 4 aa, Artificial Sequence
  Description of Artificial Sequence: Synthetic peptide
GKLT

SEQ ID NO: 4778 - protein, 5 aa, Artificial Sequence
  Description of Artificial Sequence: Synthetic peptide
GKLTM

SEQ ID NO: 4779 - protein, 4 aa, Artificial Sequence
  Description of Artificial Sequence: Synthetic peptide
GLAA

SEQ ID NO: 4780 - protein, 4 aa, Artificial Sequence
  Description of Artificial Sequence: Synthetic peptide
GLIV

SEQ ID NO: 4781 - protein, 5 aa, Artificial Sequence
  Description of Artificial Sequence: Synthetic peptide
GLLEK

SEQ ID NO: 4782 - protein, 5 aa, Artificial Sequence
  Description of Artificial Sequence: Synthetic peptide
GLLGG

SEQ ID NO: 4783 - protein, 5 aa, Artificial Sequence
  Description of Artificial Sequence: Synthetic peptide
GLLMV

SEQ ID NO: 4784 - protein, 5 aa, Artificial Sequence
  Description of Artificial Sequence: Synthetic peptide
GLLQD

SEQ ID NO: 4785 - protein, 5 aa, Artificial Sequence
  Description of Artificial Sequence: Synthetic peptide
GLLTG

SEQ ID NO: 4786 - protein, 4 aa, Artificial Sequence
  Description of Artificial Sequence: Synthetic peptide
GLSG

SEQ ID NO: 4787 - protein, 5 aa, Artificial Sequence
  Description of Artificial Sequence: Synthetic peptide
GLSGR

SEQ ID NO: 4788 - protein, 4 aa, Artificial Sequence
  Description of Artificial Sequence: Synthetic peptide
GLSV

SEQ ID NO: 4789 - protein, 4 aa, Artificial Sequence
  Description of Artificial Sequence: Synthetic peptide
GLVN

SEQ ID NO: 4790 - protein, 4 aa, Artificial Sequence
  Description of Artificial Sequence: Synthetic peptide
GLVQ

SEQ ID NO: 4791 - protein, 5 aa, Artificial Sequence
  Description of Artificial Sequence: Synthetic peptide
GMLAG

SEQ ID NO: 4792 - protein, 5 aa, Artificial Sequence
  Description of Artificial Sequence: Synthetic peptide
GNLSN

SEQ ID NO: 4793 - protein, 5 aa, Artificial Sequence
  Description of Artificial Sequence: Synthetic peptide
GPLKP

SEQ ID NO: 4794 - protein, 5 aa, Artificial Sequence
  Description of Artificial Sequence: Synthetic peptide
GPLRP

SEQ ID NO: 4795 - protein, 5 aa, Artificial Sequence
  Description of Artificial Sequence: Synthetic peptide
GPLVP

SEQ ID NO: 4796 - protein, 5 aa, Artificial Sequence
  Description of Artificial Sequence: Synthetic peptide
GQLGP

SEQ ID NO: 4797 - protein, 5 aa, Artificial Sequence
  Description of Artificial Sequence: Synthetic peptide
GQLLE

SEQ ID NO: 4798 - protein, 4 aa, Artificial Sequence
  Description of Artificial Sequence: Synthetic peptide
GRML

SEQ ID NO: 4799 - protein, 5 aa, Artificial Sequence
  Description of Artificial Sequence: Synthetic peptide
GRLGG

SEQ ID NO: 4800 - protein, 5 aa, Artificial Sequence
  Description of Artificial Sequence: Synthetic peptide
GRLLG

SEQ ID NO: 4801 - protein, 5 aa, Artificial Sequence
  Description of Artificial Sequence: Synthetic peptide
GRLMP

SEQ ID NO: 4802 - protein, 5 aa, Artificial Sequence
  Description of Artificial Sequence: Synthetic peptide
GRLVS

SEQ ID NO: 4803 - protein, 5 aa, Artificial Sequence
  Description of Artificial Sequence: Synthetic peptide
GRYGC

SEQ ID NO: 4804 - protein, 5 aa, Artificial Sequence
  Description of Artificial Sequence: Synthetic peptide
GSLSK

SEQ ID NO: 4805 - protein, 5 aa, Artificial Sequence
  Description of Artificial Sequence: Synthetic peptide
GSLSP

SEQ ID NO: 4806 - protein, 5 aa, Artificial Sequence
  Description of Artificial Sequence: Synthetic peptide
GTLKL

SEQ ID NO: 4807 - protein, 5 aa, Artificial Sequence
  Description of Artificial Sequence: Synthetic peptide
GTLLL

SEQ ID NO: 4808 - protein, 5 aa, Artificial Sequence
  Description of Artificial Sequence: Synthetic peptide
GTLMT

SEQ ID NO: 4809 - protein, 5 aa, Artificial Sequence
  Description of Artificial Sequence: Synthetic peptide
GTLTE

SEQ ID NO: 4810 - protein, 4 aa, Artificial Sequence
  Description of Artificial Sequence: Synthetic peptide
GVIN

SEQ ID NO: 4811 - protein, 5 aa, Artificial Sequence
  Description of Artificial Sequence: Synthetic peptide
GVLDN

SEQ ID NO: 4812 - protein, 4 aa, Artificial Sequence
  Description of Artificial Sequence: Synthetic peptide
GVLE

SEQ ID NO: 4813 - protein, 5 aa, Artificial Sequence
  Description of Artificial Sequence: Synthetic peptide
GVLKD

SEQ ID NO: 4814 - protein, 5 aa, Artificial Sequence
  Description of Artificial Sequence: Synthetic peptide
GVLRL

SEQ ID NO: 4815 - protein, 5 aa, Artificial Sequence
  Description of Artificial Sequence: Synthetic peptide
GVLSG

SEQ ID NO: 4816 - protein, 4 aa, Artificial Sequence
  Description of Artificial Sequence: Synthetic peptide
GVMN

SEQ ID NO: 4817 - protein, 4 aa, Artificial Sequence
  Description of Artificial Sequence: Synthetic peptide
GVPV

SEQ ID NO: 4818 - protein, 5 aa, Artificial Sequence
  Description of Artificial Sequence: Synthetic peptide
HELMR

SEQ ID NO: 4819 - protein, 5 aa, Artificial Sequence
  Description of Artificial Sequence: Synthetic peptide
HLLVP

SEQ ID NO: 4820 - protein, 5 aa, Artificial Sequence
  Description of Artificial Sequence: Synthetic peptide
HPLDR

SEQ ID NO: 4821 - protein, 5 aa, Artificial Sequence
  Description of Artificial Sequence: Synthetic peptide
HPLLS

SEQ ID NO: 4822 - protein, 5 aa, Artificial Sequence
  Description of Artificial Sequence: Synthetic peptide
HPVKE

SEQ ID NO: 4823 - protein, 5 aa, Artificial Sequence
  Description of Artificial Sequence: Synthetic peptide
HTLKM

SEQ ID NO: 4824 - protein, 5 aa, Artificial Sequence
  Description of Artificial Sequence: Synthetic peptide
HTLLK

SEQ ID NO: 4825 - protein, 5 aa, Artificial Sequence
  Description of Artificial Sequence: Synthetic peptide
HTLNI

SEQ ID NO: 4826 - protein, 5 aa, Artificial Sequence
  Description of Artificial Sequence: Synthetic peptide
HTLRP

SEQ ID NO: 4827 - protein, 5 aa, Artificial Sequence
  Description of Artificial Sequence: Synthetic peptide
IALPG

SEQ ID NO: 4828 - protein, 5 aa, Artificial Sequence
  Description of Artificial Sequence: Synthetic peptide
IELAL

SEQ ID NO: 4829 - protein, 4 aa, Artificial Sequence
  Description of Artificial Sequence: Synthetic peptide
IELG

SEQ ID NO: 4830 - protein, 5 aa, Artificial Sequence
  Description of Artificial Sequence: Synthetic peptide
IELHL

SEQ ID NO: 4831 - protein, 5 aa, Artificial Sequence
  Description of Artificial Sequence: Synthetic peptide
IGIQR

SEQ ID NO: 4832 - protein, 5 aa, Artificial Sequence
  Description of Artificial Sequence: Synthetic peptide
IGLGA

SEQ ID NO: 4833 - protein, 5 aa, Artificial Sequence
  Description of Artificial Sequence: Synthetic peptide
IGLRL

SEQ ID NO: 4834 - protein, 5 aa, Artificial Sequence
  Description of Artificial Sequence: Synthetic peptide
IHLAG

SEQ ID NO: 4835 - protein, 5 aa, Artificial Sequence
  Description of Artificial Sequence: Synthetic peptide
IHLRM

SEQ ID NO: 4836 - protein, 5 aa, Artificial Sequence
  Description of Artificial Sequence: Synthetic peptide
IKLTG

SEQ ID NO: 4837 - protein, 5 aa, Artificial Sequence
  Description of Artificial Sequence: Synthetic peptide
IMLPR

SEQ ID NO: 4838 - protein, 5 aa, Artificial Sequence
  Description of Artificial Sequence: Synthetic peptide
IQLMG

SEQ ID NO: 4839 - protein, 5 aa, Artificial Sequence
  Description of Artificial Sequence: Synthetic peptide
IQLRL

SEQ ID NO: 4840 - protein, 5 aa, Artificial Sequence
  Description of Artificial Sequence: Synthetic peptide
IRLAA

SEQ ID NO: 4841 - protein, 5 aa, Artificial Sequence
  Description of Artificial Sequence: Synthetic peptide
IRLGP

SEQ ID NO: 4842 - protein, 5 aa, Artificial Sequence
  Description of Artificial Sequence: Synthetic peptide
IRLRR

SEQ ID NO: 4843 - protein, 5 aa, Artificial Sequence
  Description of Artificial Sequence: Synthetic peptide
ISLVG

SEQ ID NO: 4844 - protein, 5 aa, Artificial Sequence
  Description of Artificial Sequence: Synthetic peptide
ITLMV

SEQ ID NO: 4845 - protein, 5 aa, Artificial Sequence
  Description of Artificial Sequence: Synthetic peptide
ITLRG

SEQ ID NO: 4846 - protein, 5 aa, Artificial Sequence
  Description of Artificial Sequence: Synthetic peptide
ITLRP

SEQ ID NO: 4847 - protein, 5 aa, Artificial Sequence
  Description of Artificial Sequence: Synthetic peptide
ITLVG

SEQ ID NO: 4848 - protein, 5 aa, Artificial Sequence
  Description of Artificial Sequence: Synthetic peptide
IVLPG

SEQ ID NO: 4849 - protein, 5 aa, Artificial Sequence
  Description of Artificial Sequence: Synthetic peptide
KGLAT

SEQ ID NO: 4850 - protein, 5 aa, Artificial Sequence
  Description of Artificial Sequence: Synthetic peptide
KGLDL

SEQ ID NO: 4851 - protein, 5 aa, Artificial Sequence
  Description of Artificial Sequence: Synthetic peptide
KGLMR

SEQ ID NO: 4852 - protein, 8 aa, Artificial Sequence
  Description of Artificial Sequence: Synthetic peptide
KGRSPVET

SEQ ID NO: 4853 - protein, 4 aa, Artificial Sequence
  Description of Artificial Sequence: Synthetic peptide
KIIV

SEQ ID NO: 4854 - protein, 5 aa, Artificial Sequence
  Description of Artificial Sequence: Synthetic peptide
KILLA

SEQ ID NO: 4855 - protein, 5 aa, Artificial Sequence
  Description of Artificial Sequence: Synthetic peptide
KKLAG

SEQ ID NO: 4856 - protein, 5 aa, Artificial Sequence
  Description of Artificial Sequence: Synthetic peptide
KKLGV

SEQ ID NO: 4857 - protein, 5 aa, Artificial Sequence
  Description of Artificial Sequence: Synthetic peptide
KKLRI

SEQ ID NO: 4858 - protein, 5 aa, Artificial Sequence
  Description of Artificial Sequence: Synthetic peptide
KLLAG

SEQ ID NO: 4859 - protein, 5 aa, Artificial Sequence
  Description of Artificial Sequence: Synthetic peptide
KLLRV

SEQ ID NO: 4860 - protein, 5 aa, Artificial Sequence
  Description of Artificial Sequence: Synthetic peptide
KPLAA

SEQ ID NO: 4861 - protein, 5 aa, Artificial Sequence
  Description of Artificial Sequence: Synthetic peptide
KPLMV

SEQ ID NO: 4862 - protein, 5 aa, Artificial Sequence
  Description of Artificial Sequence: Synthetic peptide
KRLEG

SEQ ID NO: 4863 - protein, 5 aa, Artificial Sequence
  Description of Artificial Sequence: Synthetic peptide
KSLVG

SEQ ID NO: 4864 - protein, 5 aa, Artificial Sequence
  Description of Artificial Sequence: Synthetic peptide
KTLEG

SEQ ID NO: 4865 - protein, 5 aa, Artificial Sequence
  Description of Artificial Sequence: Synthetic peptide
KTLRG

SEQ ID NO: 4866 - protein, 5 aa, Artificial Sequence
  Description of Artificial Sequence: Synthetic peptide
KTLVG

SEQ ID NO: 4867 - protein, 5 aa, Artificial Sequence
  Description of Artificial Sequence: Synthetic peptide
KVLPV

SEQ ID NO: 4868 - protein, 5 aa, Artificial Sequence
  Description of Artificial Sequence: Synthetic peptide
LAHGT

SEQ ID NO: 4869 - protein, 5 aa, Artificial Sequence
  Description of Artificial Sequence: Synthetic peptide
LGLGP

SEQ ID NO: 4870 - protein, 5 aa, Artificial Sequence
  Description of Artificial Sequence: Synthetic peptide
LGLGV

SEQ ID NO: 4871 - protein, 5 aa, Artificial Sequence
  Description of Artificial Sequence: Synthetic peptide
LKVKL

SEQ ID NO: 4872 - protein, 5 aa, Artificial Sequence
  Description of Artificial Sequence: Synthetic peptide
LNLHT

SEQ ID NO: 4873 - protein, 5 aa, Artificial Sequence
  Description of Artificial Sequence: Synthetic peptide
LRLIM

SEQ ID NO: 4874 - protein, 5 aa, Artificial Sequence
  Description of Artificial Sequence: Synthetic peptide
LRVIG

SEQ ID NO: 4875 - protein, 5 aa, Artificial Sequence
  Description of Artificial Sequence: Synthetic peptide
LSLSG

SEQ ID NO: 4876 - protein, 5 aa, Artificial Sequence
  Description of Artificial Sequence: Synthetic peptide
LTLQQ

SEQ ID NO: 4877 - protein, 5 aa, Artificial Sequence
  Description of Artificial Sequence: Synthetic peptide
LVLRG

SEQ ID NO: 4878 - protein, 5 aa, Artificial Sequence
  Description of Artificial Sequence: Synthetic peptide
MALRG

SEQ ID NO: 4879 - protein, 5 aa, Artificial Sequence
  Description of Artificial Sequence: Synthetic peptide
MELIG

SEQ ID NO: 4880 - protein, 5 aa, Artificial Sequence
  Description of Artificial Sequence: Synthetic peptide
MGLRV

SEQ ID NO: 4881 - protein, 4 aa, Artificial Sequence
  Description of Artificial Sequence: Synthetic peptide
MLAA

SEQ ID NO: 4882 - protein, 5 aa, Artificial Sequence
  Description of Artificial Sequence: Synthetic peptide
MLLIS

SEQ ID NO: 4883 - protein, 5 aa, Artificial Sequence
  Description of Artificial Sequence: Synthetic peptide
MLLLP

SEQ ID NO: 4884 - protein, 5 aa, Artificial Sequence
  Description of Artificial Sequence: Synthetic peptide
MLLMV

SEQ ID NO: 4885 - protein, 5 aa, Artificial Sequence
  Description of Artificial Sequence: Synthetic peptide
MLLPP

SEQ ID NO: 4886 - protein, 5 aa, Artificial Sequence
  Description of Artificial Sequence: Synthetic peptide
MLLPV

SEQ ID NO: 4887 - protein, 4 aa, Artificial Sequence
  Description of Artificial Sequence: Synthetic peptide
MLLV

SEQ ID NO: 4888 - protein, 5 aa, Artificial Sequence
  Description of Artificial Sequence: Synthetic peptide
MLLVG

SEQ ID NO: 4889 - protein, 4 aa, Artificial Sequence
  Description of Artificial Sequence: Synthetic peptide
MLVG

SEQ ID NO: 4890 - protein, 5 aa, Artificial Sequence
  Description of Artificial Sequence: Synthetic peptide
MMLDP

SEQ ID NO: 4891 - protein, 5 aa, Artificial Sequence
  Description of Artificial Sequence: Synthetic peptide
MPLGA

SEQ ID NO: 4892 - protein, 5 aa, Artificial Sequence
  Description of Artificial Sequence: Synthetic peptide
MPLGL

SEQ ID NO: 4893 - protein, 5 aa, Artificial Sequence
  Description of Artificial Sequence: Synthetic peptide
MPLLG

SEQ ID NO: 4894 - protein, 5 aa, Artificial Sequence
  Description of Artificial Sequence: Synthetic peptide
MRLEE

SEQ ID NO: 4895 - protein, 5 aa, Artificial Sequence
  Description of Artificial Sequence: Synthetic peptide
MRLGA

SEQ ID NO: 4896 - protein, 5 aa, Artificial Sequence
  Description of Artificial Sequence: Synthetic peptide
MRLGG

SEQ ID NO: 4897 - protein, 5 aa, Artificial Sequence
  Description of Artificial Sequence: Synthetic peptide
MRLGR

SEQ ID NO: 4898 - protein, 5 aa, Artificial Sequence
  Description of Artificial Sequence: Synthetic peptide
MSLHG

SEQ ID NO: 4899 - protein, 5 aa, Artificial Sequence
  Description of Artificial Sequence: Synthetic peptide
MSLQQ

SEQ ID NO: 4900 - protein, 5 aa, Artificial Sequence
  Description of Artificial Sequence: Synthetic peptide
MTLER

SEQ ID NO: 4901 - protein, 5 aa, Artificial Sequence
  Description of Artificial Sequence: Synthetic peptide
MVLMN

SEQ ID NO: 4902 - protein, 5 aa, Artificial Sequence
  Description of Artificial Sequence: Synthetic peptide
MVLNT

SEQ ID NO: 4903 - protein, 5 aa, Artificial Sequence
  Description of Artificial Sequence: Synthetic peptide
MVLRG

SEQ ID NO: 4904 - protein, 5 aa, Artificial Sequence
  Description of Artificial Sequence: Synthetic peptide
MVLVT

SEQ ID NO: 4905 - protein, 5 aa, Artificial Sequence
  Description of Artificial Sequence: Synthetic peptide
MVVAS

SEQ ID NO: 4906 - protein, 7 aa, Artificial Sequence
  Description of Artificial Sequence: Synthetic peptide
NDALQYD

SEQ ID NO: 4907 - protein, 12 aa, Artificial Sequence
  Description of Artificial Sequence: Synthetic peptide
NDALQYESECGP

SEQ ID NO: 4908 - protein, 5 aa, Artificial Sequence
  Description of Artificial Sequence: Synthetic peptide
NELLR

SEQ ID NO: 4909 - protein, 5 aa, Artificial Sequence
  Description of Artificial Sequence: Synthetic peptide
NELMR

SEQ ID NO: 4910 - protein, 5 aa, Artificial Sequence
  Description of Artificial Sequence: Synthetic peptide
NELRV

SEQ ID NO: 4911 - protein, 4 aa, Artificial Sequence
  Description of Artificial Sequence: Synthetic peptide
NGLG

SEQ ID NO: 4912 - protein, 16 aa, Artificial Sequence
  Description of Artificial Sequence: Synthetic peptide
NGLIVHIRSHTGERPF

SEQ ID NO: 4913 - protein, 7 aa, Artificial Sequence
  Description of Artificial Sequence: Synthetic peptide
NGRPPGE

SEQ ID NO: 4914 - protein, 7 aa, Artificial Sequence
  Description of Artificial Sequence: Synthetic peptide
NGRSPVR

SEQ ID NO: 4915 - protein, 5 aa, Artificial Sequence
  Description of Artificial Sequence: Synthetic peptide
NILMG

SEQ ID NO: 4916 - protein, 5 aa, Artificial Sequence
  Description of Artificial Sequence: Synthetic peptide
NKLAR

SEQ ID NO: 4917 - protein, 5 aa, Artificial Sequence
  Description of Artificial Sequence: Synthetic peptide
NKLRA

SEQ ID NO: 4918 - protein, 5 aa, Artificial Sequence
  Description of Artificial Sequence: Synthetic peptide
NKLRG

SEQ ID NO: 4919 - protein, 5 aa, Artificial Sequence
  Description of Artificial Sequence: Synthetic peptide
NKLVA

SEQ ID NO: 4920 - protein, 5 aa, Artificial Sequence
  Description of Artificial Sequence: Synthetic peptide
NKLVK

SEQ ID NO: 4921 - protein, 5 aa, Artificial Sequence
  Description of Artificial Sequence: Synthetic peptide
NMLGV

SEQ ID NO: 4922 - protein, 5 aa, Artificial Sequence
  Description of Artificial Sequence: Synthetic peptide
NNLIN

SEQ ID NO: 4923 - protein, 5 aa, Artificial Sequence
  Description of Artificial Sequence: Synthetic peptide
NRLRI

SEQ ID NO: 4924 - protein, 4 aa, Artificial Sequence
  Description of Artificial Sequence: Synthetic peptide
NSLV

SEQ ID NO: 4925 - protein, 5 aa, Artificial Sequence
  Description of Artificial Sequence: Synthetic peptide
NSLVA

SEQ ID NO: 4926 - protein, 10 aa, Artificial Sequence
  Description of Artificial Sequence: Synthetic peptide
NVHPVVGLAA

SEQ ID NO: 4927 - protein, 5 aa, Artificial Sequence
  Description of Artificial Sequence: Synthetic peptide
NVLGE

SEQ ID NO: 4928 - protein, 5 aa, Artificial Sequence
  Description of Artificial Sequence: Synthetic peptide
PALAG

SEQ ID NO: 4929 - protein, 5 aa, Artificial Sequence
  Description of Artificial Sequence: Synthetic peptide
PALGP

SEQ ID NO: 4930 - protein, 4 aa, Artificial Sequence
  Description of Artificial Sequence: Synthetic peptide
PALV

SEQ ID NO: 4931 - protein, 4 aa, Artificial Sequence
  Description of Artificial Sequence: Synthetic peptide
PASV

SEQ ID NO: 4932 - protein, 5 aa, Artificial Sequence
  Description of Artificial Sequence: Synthetic peptide
PDLRA

SEQ ID NO: 4933 - protein, 5 aa, Artificial Sequence
  Description of Artificial Sequence: Synthetic peptide
PGITE

SEQ ID NO: 4934 - protein, 5 aa, Artificial Sequence
  Description of Artificial Sequence: Synthetic peptide
PGLAP

SEQ ID NO: 4935 - protein, 5 aa, Artificial Sequence
  Description of Artificial Sequence: Synthetic peptide
PGLHE

SEQ ID NO: 4936 - protein, 5 aa, Artificial Sequence
  Description of Artificial Sequence: Synthetic peptide
PGVAA

SEQ ID NO: 4937 - protein, 5 aa, Artificial Sequence
  Description of Artificial Sequence: Synthetic peptide
PGVVP

SEQ ID NO: 4938 - protein, 5 aa, Artificial Sequence
  Description of Artificial Sequence: Synthetic peptide
PHLKR

SEQ ID NO: 4939 - protein, 5 aa, Artificial Sequence
  Description of Artificial Sequence: Synthetic peptide
PKLIF

SEQ ID NO: 4940 - protein, 4 aa, Artificial Sequence
  Description of Artificial Sequence: Synthetic peptide
PLRG

SEQ ID NO: 4941 - protein, 5 aa, Artificial Sequence
  Description of Artificial Sequence: Synthetic peptide
PMLAG

SEQ ID NO: 4942 - protein, 5 aa, Artificial Sequence
  Description of Artificial Sequence: Synthetic peptide
PMLTM

SEQ ID NO: 4943 - protein, 5 aa, Artificial Sequence
  Description of Artificial Sequence: Synthetic peptide
PNLAS

SEQ ID NO: 4944 - protein, 5 aa, Artificial Sequence
  Description of Artificial Sequence: Synthetic peptide
PNYWS

SEQ ID NO: 4945 - protein, 5 aa, Artificial Sequence
  Description of Artificial Sequence: Synthetic peptide
PQLVV

SEQ ID NO: 4946 - protein, 7 aa, Artificial Sequence
  Description of Artificial Sequence: Synthetic peptide
PQSRGRG

SEQ ID NO: 4947 - protein, 4 aa, Artificial Sequence
  Description of Artificial Sequence: Synthetic peptide
PRGA

SEQ ID NO: 4948 - protein, 5 aa, Artificial Sequence
  Description of Artificial Sequence: Synthetic peptide
PRLRL

SEQ ID NO: 4949 - protein, 4 aa, Artificial Sequence
  Description of Artificial Sequence: Synthetic peptide
PSFQ

SEQ ID NO: 4950 - protein, 5 aa, Artificial Sequence
  Description of Artificial Sequence: Synthetic peptide
PTLAK

SEQ ID NO: 4951 - protein, 5 aa, Artificial Sequence
  Description of Artificial Sequence: Synthetic peptide
PVLKV

SEQ ID NO: 4952 - protein, 5 aa, Artificial Sequence
  Description of Artificial Sequence: Synthetic peptide
PVLMT

SEQ ID NO: 4953 - protein, 5 aa, Artificial Sequence
  Description of Artificial Sequence: Synthetic peptide
QALRG

SEQ ID NO: 4954 - protein, 5 aa, Artificial Sequence
  Description of Artificial Sequence: Synthetic peptide
QALSP

SEQ ID NO: 4955 - protein, 5 aa, Artificial Sequence
  Description of Artificial Sequence: Synthetic peptide
QGLHL

SEQ ID NO: 4956 - protein, 5 aa, Artificial Sequence
  Description of Artificial Sequence: Synthetic peptide
QILLQ

SEQ ID NO: 4957 - protein, 16 aa, Artificial Sequence
  Description of Artificial Sequence: Synthetic peptide
QILLRHIRSHTGERPF

SEQ ID NO: 4958 - protein, 5 aa, Artificial Sequence
  Description of Artificial Sequence: Synthetic peptide
QILLY

SEQ ID NO: 4959 - protein, 5 aa, Artificial Sequence
  Description of Artificial Sequence: Synthetic peptide
QILPE

SEQ ID NO: 4960 - protein, 5 aa, Artificial Sequence
  Description of Artificial Sequence: Synthetic peptide
QMLAR

SEQ ID NO: 4961 - protein, 5 aa, Artificial Sequence
  Description of Artificial Sequence: Synthetic peptide
QPLAV

SEQ ID NO: 4962 - protein, 5 aa, Artificial Sequence
  Description of Artificial Sequence: Synthetic peptide
QPLTM

SEQ ID NO: 4963 - protein, 5 aa, Artificial Sequence
  Description of Artificial Sequence: Synthetic peptide
QRLGG

SEQ ID NO: 4964 - protein, 5 aa, Artificial Sequence
  Description of Artificial Sequence: Synthetic peptide
QTLAV

SEQ ID NO: 4965 - protein, 5 aa, Artificial Sequence
  Description of Artificial Sequence: Synthetic peptide
QTLGG

SEQ ID NO: 4966 - protein, 5 aa, Artificial Sequence
  Description of Artificial Sequence: Synthetic peptide
QTLGP

SEQ ID NO: 4967 - protein, 5 aa, Artificial Sequence
  Description of Artificial Sequence: Synthetic peptide
REIVR

SEQ ID NO: 4968 - protein, 5 aa, Artificial Sequence
  Description of Artificial Sequence: Synthetic peptide
RELRR

SEQ ID NO: 4969 - protein, 5 aa, Artificial Sequence
  Description of Artificial Sequence: Synthetic peptide
RGLAA

SEQ ID NO: 4970 - protein, 5 aa, Artificial Sequence
  Description of Artificial Sequence: Synthetic peptide
RGLDN

SEQ ID NO: 4971 - protein, 5 aa, Artificial Sequence
  Description of Artificial Sequence: Synthetic peptide
RGLNS

SEQ ID NO: 4972 - protein, 5 aa, Artificial Sequence
  Description of Artificial Sequence: Synthetic peptide
RGLRS

SEQ ID NO: 4973 - protein, 5 aa, Artificial Sequence
  Description of Artificial Sequence: Synthetic peptide
RGLTG

SEQ ID NO: 4974 - protein, 5 aa, Artificial Sequence
  Description of Artificial Sequence: Synthetic peptide
RGLVE

SEQ ID NO: 4975 - protein, 5 aa, Artificial Sequence
  Description of Artificial Sequence: Synthetic peptide
RGYGT

SEQ ID NO: 4976 - protein, 5 aa, Artificial Sequence
  Description of Artificial Sequence: Synthetic peptide
RHLKM

SEQ ID NO: 4977 - protein, 5 aa, Artificial Sequence
  Description of Artificial Sequence: Synthetic peptide
RLLGL

SEQ ID NO: 4978 - protein, 4 aa, Artificial Sequence
  Description of Artificial Sequence: Synthetic peptide
RPSG

SEQ ID NO: 4979 - protein, 5 aa, Artificial Sequence
  Description of Artificial Sequence: Synthetic peptide
RPLAG

SEQ ID NO: 4980 - protein, 5 aa, Artificial Sequence
  Description of Artificial Sequence: Synthetic peptide
RQLGK

SEQ ID NO: 4981 - protein, 5 aa, Artificial Sequence
  Description of Artificial Sequence: Synthetic peptide
RQLLE

SEQ ID NO: 4982 - protein, 5 aa, Artificial Sequence
  Description of Artificial Sequence: Synthetic peptide
RRLEA

SEQ ID NO: 4983 - protein, 5 aa, Artificial Sequence
  Description of Artificial Sequence: Synthetic peptide
RRLET

SEQ ID NO: 4984 - protein, 5 aa, Artificial Sequence
  Description of Artificial Sequence: Synthetic peptide
RRLGS

SEQ ID NO: 4985 - protein, 5 aa, Artificial Sequence
  Description of Artificial Sequence: Synthetic peptide
RRLSE

SEQ ID NO: 4986 - protein, 5 aa, Artificial Sequence
  Description of Artificial Sequence: Synthetic peptide
RRLTP

SEQ ID NO: 4987 - protein, 5 aa, Artificial Sequence
  Description of Artificial Sequence: Synthetic peptide
RRVVG

SEQ ID NO: 4988 - protein, 5 aa, Artificial Sequence
  Description of Artificial Sequence: Synthetic peptide
RTLKL

SEQ ID NO: 4989 - protein, 5 aa, Artificial Sequence
  Description of Artificial Sequence: Synthetic peptide
RTLVG

SEQ ID NO: 4990 - protein, 5 aa, Artificial Sequence
  Description of Artificial Sequence: Synthetic peptide
RVLEP

SEQ ID NO: 4991 - protein, 5 aa, Artificial Sequence
  Description of Artificial Sequence: Synthetic peptide
RVLRE

SEQ ID NO: 4992 - protein, 4 aa, Artificial Sequence
  Description of Artificial Sequence: Synthetic peptide
SCLK

SEQ ID NO: 4993 - protein, 5 aa, Artificial Sequence
  Description of Artificial Sequence: Synthetic peptide
SGILV

SEQ ID NO: 4994 - protein, 5 aa, Artificial Sequence
  Description of Artificial Sequence: Synthetic peptide
SGLGG

SEQ ID NO: 4995 - protein, 5 aa, Artificial Sequence
  Description of Artificial Sequence: Synthetic peptide
SGLGL

SEQ ID NO: 4996 - protein, 5 aa, Artificial Sequence
  Description of Artificial Sequence: Synthetic peptide
SGLGT

SEQ ID NO: 4997 - protein, 5 aa, Artificial Sequence
  Description of Artificial Sequence: Synthetic peptide
SGLLG

SEQ ID NO: 4998 - protein, 5 aa, Artificial Sequence
  Description of Artificial Sequence: Synthetic peptide
SGLNL

SEQ ID NO: 4999 - protein, 5 aa, Artificial Sequence
  Description of Artificial Sequence: Synthetic peptide
SGLRL

SEQ ID NO: 5000 - protein, 5 aa, Artificial Sequence
  Description of Artificial Sequence: Synthetic peptide
SGLVG

SEQ ID NO: 5001 - protein, 5 aa, Artificial Sequence
  Description of Artificial Sequence: Synthetic peptide
SKLLG

SEQ ID NO: 5002 - protein, 4 aa, Artificial Sequence
  Description of Artificial Sequence: Synthetic peptide
SLHG

SEQ ID NO: 5003 - protein, 5 aa, Artificial Sequence
  Description of Artificial Sequence: Synthetic peptide
SLLRT

SEQ ID NO: 5004 - protein, 5 aa, Artificial Sequence
  Description of Artificial Sequence: Synthetic peptide
SNLTY

SEQ ID NO: 5005 - protein, 5 aa, Artificial Sequence
  Description of Artificial Sequence: Synthetic peptide
SNYWP

SEQ ID NO: 5006 - protein, 5 aa, Artificial Sequence
  Description of Artificial Sequence: Synthetic peptide
SPLIG

SEQ ID NO: 5007 - protein, 5 aa, Artificial Sequence
  Description of Artificial Sequence: Synthetic peptide
SPLKI

SEQ ID NO: 5008 - protein, 5 aa, Artificial Sequence
  Description of Artificial Sequence: Synthetic peptide
SPLRN

SEQ ID NO: 5009 - protein, 4 aa, Artificial Sequence
  Description of Artificial Sequence: Synthetic peptide
SQMK

SEQ ID NO: 5010 - protein, 5 aa, Artificial Sequence
  Description of Artificial Sequence: Synthetic peptide
SRLMT

SEQ ID NO: 5011 - protein, 5 aa, Artificial Sequence
  Description of Artificial Sequence: Synthetic peptide
SRLVT

SEQ ID NO: 5012 - protein, 5 aa, Artificial Sequence
  Description of Artificial Sequence: Synthetic peptide
SSLGA

SEQ ID NO: 5013 - protein, 5 aa, Artificial Sequence
  Description of Artificial Sequence: Synthetic peptide
SSLGL

SEQ ID NO: 5014 - protein, 5 aa, Artificial Sequence
  Description of Artificial Sequence: Synthetic peptide
STLQK

SEQ ID NO: 5015 - protein, 5 aa, Artificial Sequence
  Description of Artificial Sequence: Synthetic peptide
SVLVG

SEQ ID NO: 5016 - protein, 5 aa, Artificial Sequence
  Description of Artificial Sequence: Synthetic peptide
SVLVS

SEQ ID NO: 5017 - protein, 5 aa, Artificial Sequence
  Description of Artificial Sequence: Synthetic peptide
TALEA

SEQ ID NO: 5018 - protein, 5 aa, Artificial Sequence
  Description of Artificial Sequence: Synthetic peptide
TALKG

SEQ ID NO: 5019 - protein, 4 aa, Artificial Sequence
  Description of Artificial Sequence: Synthetic peptide
TELE

SEQ ID NO: 5020 - protein, 5 aa, Artificial Sequence
  Description of Artificial Sequence: Synthetic peptide
TELIR

SEQ ID NO: 5021 - protein, 5 aa, Artificial Sequence
  Description of Artificial Sequence: Synthetic peptide
TELPR

SEQ ID NO: 5022 - protein, 5 aa, Artificial Sequence
  Description of Artificial Sequence: Synthetic peptide
TELRV

SEQ ID NO: 5023 - protein, 5 aa, Artificial Sequence
  Description of Artificial Sequence: Synthetic peptide
TGLAD

SEQ ID NO: 5024 - protein, 5 aa, Artificial Sequence
  Description of Artificial Sequence: Synthetic peptide
TGLGA

SEQ ID NO: 5025 - protein, 5 aa, Artificial Sequence
  Description of Artificial Sequence: Synthetic peptide
THLAN

SEQ ID NO: 5026 - protein, 5 aa, Artificial Sequence
  Description of Artificial Sequence: Synthetic peptide
THLAV

SEQ ID NO: 5027 - protein, 5 aa, Artificial Sequence
  Description of Artificial Sequence: Synthetic peptide
TKLLR

SEQ ID NO: 5028 - protein, 5 aa, Artificial Sequence
  Description of Artificial Sequence: Synthetic peptide
TKLME

SEQ ID NO: 5029 - protein, 5 aa, Artificial Sequence
  Description of Artificial Sequence: Synthetic peptide
TKLRR

SEQ ID NO: 5030 - protein, 5 aa, Artificial Sequence
  Description of Artificial Sequence: Synthetic peptide
TKLVL

SEQ ID NO: 5031 - protein, 5 aa, Artificial Sequence
  Description of Artificial Sequence: Synthetic peptide
TKSGV

SEQ ID NO: 5032 - protein, 4 aa, Artificial Sequence
  Description of Artificial Sequence: Synthetic peptide
TLIS

SEQ ID NO: 5033 - protein, 5 aa, Artificial Sequence
  Description of Artificial Sequence: Synthetic peptide
TLLIR

SEQ ID NO: 5034 - protein, 4 aa, Artificial Sequence
  Description of Artificial Sequence: Synthetic peptide
TLLM

SEQ ID NO: 5035 - protein, 5 aa, Artificial Sequence
  Description of Artificial Sequence: Synthetic peptide
TLLMQ

SEQ ID NO: 5036 - protein, 4 aa, Artificial Sequence
  Description of Artificial Sequence: Synthetic peptide
TLNG

SEQ ID NO: 5037 - protein, 4 aa, Artificial Sequence
  Description of Artificial Sequence: Synthetic peptide
TLQP

SEQ ID NO: 5038 - protein, 5 aa, Artificial Sequence
  Description of Artificial Sequence: Synthetic peptide
TMLDP

SEQ ID NO: 5039 - protein, 5 aa, Artificial Sequence
  Description of Artificial Sequence: Synthetic peptide
TMLRE

SEQ ID NO: 5040 - protein, 5 aa, Artificial Sequence
  Description of Artificial Sequence: Synthetic peptide
TNLVG

SEQ ID NO: 5041 - protein, 5 aa, Artificial Sequence
  Description of Artificial Sequence: Synthetic peptide
TPLIV

SEQ ID NO: 5042 - protein, 5 aa, Artificial Sequence
  Description of Artificial Sequence: Synthetic peptide
TPLMQ

SEQ ID NO: 5043 - protein, 5 aa, Artificial Sequence
  Description of Artificial Sequence: Synthetic peptide
TPLSD

SEQ ID NO: 5044 - protein, 5 aa, Artificial Sequence
  Description of Artificial Sequence: Synthetic peptide
TPLSI

SEQ ID NO: 5045 - protein, 5 aa, Artificial Sequence
  Description of Artificial Sequence: Synthetic peptide
TQLED

SEQ ID NO: 5046 - protein, 5 aa, Artificial Sequence
  Description of Artificial Sequence: Synthetic peptide
TRLGA

SEQ ID NO: 5047 - protein, 5 aa, Artificial Sequence
  Description of Artificial Sequence: Synthetic peptide
TRLMI

SEQ ID NO: 5048 - protein, 5 aa, Artificial Sequence
  Description of Artificial Sequence: Synthetic peptide
TRLRL

SEQ ID NO: 5049 - protein, 5 aa, Artificial Sequence
  Description of Artificial Sequence: Synthetic peptide
TRLTG

SEQ ID NO: 5050 - protein, 5 aa, Artificial Sequence
  Description of Artificial Sequence: Synthetic peptide
TSLSE

SEQ ID NO: 5051 - protein, 5 aa, Artificial Sequence
  Description of Artificial Sequence: Synthetic peptide
TTLEP

SEQ ID NO: 5052 - protein, 5 aa, Artificial Sequence
  Description of Artificial Sequence: Synthetic peptide
TTLGV

SEQ ID NO: 5053 - protein, 5 aa, Artificial Sequence
  Description of Artificial Sequence: Synthetic peptide
TVLGG

SEQ ID NO: 5054 - protein, 4 aa, Artificial Sequence
  Description of Artificial Sequence: Synthetic peptide
TVLT

SEQ ID NO: 5055 - protein, 5 aa, Artificial Sequence
  Description of Artificial Sequence: Synthetic peptide
VALHT

SEQ ID NO: 5056 - protein, 5 aa, Artificial Sequence
  Description of Artificial Sequence: Synthetic peptide
VDLLL

SEQ ID NO: 5057 - protein, 5 aa, Artificial Sequence
  Description of Artificial Sequence: Synthetic peptide
VELAP

SEQ ID NO: 5058 - protein, 4 aa, Artificial Sequence
  Description of Artificial Sequence: Synthetic peptide
VELN

SEQ ID NO: 5059 - protein, 5 aa, Artificial Sequence
  Description of Artificial Sequence: Synthetic peptide
VELNN

SEQ ID NO: 5060 - protein, 5 aa, Artificial Sequence
  Description of Artificial Sequence: Synthetic peptide
VELRV

SEQ ID NO: 5061 - protein, 5 aa, Artificial Sequence
  Description of Artificial Sequence: Synthetic peptide
VGLPV

SEQ ID NO: 5062 - protein, 5 aa, Artificial Sequence
  Description of Artificial Sequence: Synthetic peptide
VGLQA

SEQ ID NO: 5063 - protein, 5 aa, Artificial Sequence
  Description of Artificial Sequence: Synthetic peptide
VGLRN

SEQ ID NO: 5064 - protein, 5 aa, Artificial Sequence
  Description of Artificial Sequence: Synthetic peptide
VGLRV

SEQ ID NO: 5065 - protein, 5 aa, Artificial Sequence
  Description of Artificial Sequence: Synthetic peptide
VGLSP

SEQ ID NO: 5066 - protein, 5 aa, Artificial Sequence
  Description of Artificial Sequence: Synthetic peptide
VGLSQ

SEQ ID NO: 5067 - protein, 5 aa, Artificial Sequence
  Description of Artificial Sequence: Synthetic peptide
VHLAL

SEQ ID NO: 5068 - protein, 5 aa, Artificial Sequence
  Description of Artificial Sequence: Synthetic peptide
VKLMA

SEQ ID NO: 5069 - protein, 5 aa, Artificial Sequence
  Description of Artificial Sequence: Synthetic peptide
VKLQN

SEQ ID NO: 5070 - protein, 5 aa, Artificial Sequence
  Description of Artificial Sequence: Synthetic peptide
VLLAA

SEQ ID NO: 5071 - protein, 5 aa, Artificial Sequence
  Description of Artificial Sequence: Synthetic peptide
VLLIE

SEQ ID NO: 5072 - protein, 5 aa, Artificial Sequence
  Description of Artificial Sequence: Synthetic peptide
VLLKI

SEQ ID NO: 5073 - protein, 5 aa, Artificial Sequence
  Description of Artificial Sequence: Synthetic peptide
VLLTP

SEQ ID NO: 5074 - protein, 4 aa, Artificial Sequence
  Description of Artificial Sequence: Synthetic peptide
VLMV

SEQ ID NO: 5075 - protein, 4 aa, Artificial Sequence
  Description of Artificial Sequence: Synthetic peptide
VLQR

SEQ ID NO: 5076 - protein, 5 aa, Artificial Sequence
  Description of Artificial Sequence: Synthetic peptide
VMLRG

SEQ ID NO: 5077 - protein, 5 aa, Artificial Sequence
  Description of Artificial Sequence: Synthetic peptide
VPLVG

SEQ ID NO: 5078 - protein, 5 aa, Artificial Sequence
  Description of Artificial Sequence: Synthetic peptide
VQLPM

SEQ ID NO: 5079 - protein, 5 aa, Artificial Sequence
  Description of Artificial Sequence: Synthetic peptide
VQLRV

SEQ ID NO: 5080 - protein, 5 aa, Artificial Sequence
  Description of Artificial Sequence: Synthetic peptide
VRLEG

SEQ ID NO: 5081 - protein, 5 aa, Artificial Sequence
  Description of Artificial Sequence: Synthetic peptide
VRLGG

SEQ ID NO: 5082 - protein, 5 aa, Artificial Sequence
  Description of Artificial Sequence: Synthetic peptide
VRLVR

SEQ ID NO: 5083 - protein, 5 aa, Artificial Sequence
  Description of Artificial Sequence: Synthetic peptide
VTLER

SEQ ID NO: 5084 - protein, 5 aa, Artificial Sequence
  Description of Artificial Sequence: Synthetic peptide
VTLGS

SEQ ID NO: 5085 - protein, 5 aa, Artificial Sequence
  Description of Artificial Sequence: Synthetic peptide
SNLKR

SEQ ID NO: 5086 - protein, 5 aa, Artificial Sequence
  Description of Artificial Sequence: Synthetic peptide
SNLTR

SEQ ID NO: 5087 - protein, 5 aa, Artificial Sequence
  Description of Artificial Sequence: Synthetic peptide
NNLKR

SEQ ID NO: 5088 - protein, 5 aa, Artificial Sequence
  Description of Artificial Sequence: Synthetic peptide
SNLIR

SEQ ID NO: 5089 - protein, 5 aa, Artificial Sequence
  Description of Artificial Sequence: Synthetic peptide
ANLMR

SEQ ID NO: 5090 - protein, 5 aa, Artificial Sequence
  Description of Artificial Sequence: Synthetic peptide
SNLNR

SEQ ID NO: 5091 - protein, 5 aa, Artificial Sequence
  Description of Artificial Sequence: Synthetic peptide
ANLTR

SEQ ID NO: 5092 - protein, 5 aa, Artificial Sequence
  Description of Artificial Sequence: Synthetic peptide
ANLQR

SEQ ID NO: 5093 - protein, 5 aa, Artificial Sequence
  Description of Artificial Sequence: Synthetic peptide
ANLER

SEQ ID NO: 5094 - protein, 5 aa, Artificial Sequence
  Description of Artificial Sequence: Synthetic peptide
ANLHR

SEQ ID NO: 5095 - protein, 5 aa, Artificial Sequence
  Description of Artificial Sequence: Synthetic peptide
ANLLR

SEQ ID NO: 5096 - protein, 5 aa, Artificial Sequence
  Description of Artificial Sequence: Synthetic peptide
RNLQR

SEQ ID NO: 5097 - protein, 5 aa, Artificial Sequence
  Description of Artificial Sequence: Synthetic peptide
SNLER

SEQ ID NO: 5098 - protein, 5 aa, Artificial Sequence
  Description of Artificial Sequence: Synthetic peptide
KNLQR

SEQ ID NO: 5099 - protein, 5 aa, Artificial Sequence
  Description of Artificial Sequence: Synthetic peptide
RNLRR

SEQ ID NO: 5100 - protein, 5 aa, Artificial Sequence
  Description of Artificial Sequence: Synthetic peptide
QNLKR

SEQ ID NO: 5101 - protein, 5 aa, Artificial Sequence
  Description of Artificial Sequence: Synthetic peptide
KNLER

SEQ ID NO: 5102 - protein, 5 aa, Artificial Sequence
  Description of Artificial Sequence: Synthetic peptide
SMLQR

SEQ ID NO: 5103 - protein, 5 aa, Artificial Sequence
  Description of Artificial Sequence: Synthetic peptide
KNLVR

SEQ ID NO: 5104 - protein, 5 aa, Artificial Sequence
  Description of Artificial Sequence: Synthetic peptide
AMLTR

SEQ ID NO: 5105 - protein, 5 aa, Artificial Sequence
  Description of Artificial Sequence: Synthetic peptide
TNLTR

SEQ ID NO: 5106 - protein, 5 aa, Artificial Sequence
  Description of Artificial Sequence: Synthetic peptide
HNLMR

SEQ ID NO: 5107 - protein, 5 aa, Artificial Sequence
  Description of Artificial Sequence: Synthetic peptide
AMLQR

SEQ ID NO: 5108 - protein, 5 aa, Artificial Sequence
  Description of Artificial Sequence: Synthetic peptide
GMLER

SEQ ID NO: 5109 - protein, 5 aa, Artificial Sequence
  Description of Artificial Sequence: Synthetic peptide
RLLIN

SEQ ID NO: 5110 - protein, 5 aa, Artificial Sequence
  Description of Artificial Sequence: Synthetic peptide
SGLLK

SEQ ID NO: 5111 - protein, 5 aa, Artificial Sequence
  Description of Artificial Sequence: Synthetic peptide
AHLVR

SEQ ID NO: 5112 - protein, 5 aa, Artificial Sequence
  Description of Artificial Sequence: Synthetic peptide
ISLRV

SEQ ID NO: 5113 - protein, 5 aa, Artificial Sequence
  Description of Artificial Sequence: Synthetic peptide
AHLKR

SEQ ID NO: 5114 - protein, 5 aa, Artificial Sequence
  Description of Artificial Sequence: Synthetic peptide
GNLRK

SEQ ID NO: 5115 - protein, 5 aa, Artificial Sequence
  Description of Artificial Sequence: Synthetic peptide
KKLLR

SEQ ID NO: 5116 - protein, 5 aa, Artificial Sequence
  Description of Artificial Sequence: Synthetic peptide
MNLRR

SEQ ID NO: 5117 - protein, 5 aa, Artificial Sequence
  Description of Artificial Sequence: Synthetic peptide
MVLLR

SEQ ID NO: 5118 - protein, 5 aa, Artificial Sequence
  Description of Artificial Sequence: Synthetic peptide
NNLQR

SEQ ID NO: 5119 - protein, 5 aa, Artificial Sequence
  Description of Artificial Sequence: Synthetic peptide
QNLVR

SEQ ID NO: 5120 - protein, 5 aa, Artificial Sequence
  Description of Artificial Sequence: Synthetic peptide
RNLAR

SEQ ID NO: 5121 - protein, 5 aa, Artificial Sequence
  Description of Artificial Sequence: Synthetic peptide
TVLLV

SEQ ID NO: 5122 - protein, 5 aa, Artificial Sequence
  Description of Artificial Sequence: Synthetic peptide
GMLNR

SEQ ID NO: 5123 - protein, 5 aa, Artificial Sequence
  Description of Artificial Sequence: Synthetic peptide
GMLTR

SEQ ID NO: 5124 - protein, 5 aa, Artificial Sequence
  Description of Artificial Sequence: Synthetic peptide
GMLVR

SEQ ID NO: 5125 - protein, 5 aa, Artificial Sequence
  Description of Artificial Sequence: Synthetic peptide
GNLRG

SEQ ID NO: 5126 - protein, 5 aa, Artificial Sequence
  Description of Artificial Sequence: Synthetic peptide
GNLVK

SEQ ID NO: 5127 - protein, 5 aa, Artificial Sequence
  Description of Artificial Sequence: Synthetic peptide
KNLRR

SEQ ID NO: 5128 - protein, 5 aa, Artificial Sequence
  Description of Artificial Sequence: Synthetic peptide
MNLKR

SEQ ID NO: 5129 - protein, 5 aa, Artificial Sequence
  Description of Artificial Sequence: Synthetic peptide
STLEV

SEQ ID NO: 5130 - protein, 5 aa, Artificial Sequence
  Description of Artificial Sequence: Synthetic peptide
TALRS

SEQ ID NO: 5131 - protein, 5 aa, Artificial Sequence
  Description of Artificial Sequence: Synthetic peptide
TNLIR

SEQ ID NO: 5132 - protein, 5 aa, Artificial Sequence
  Description of Artificial Sequence: Synthetic peptide
AMLNR

SEQ ID NO: 5133 - protein, 5 aa, Artificial Sequence
  Description of Artificial Sequence: Synthetic peptide
ANLRL

SEQ ID NO: 5134 - protein, 5 aa, Artificial Sequence
  Description of Artificial Sequence: Synthetic peptide
ANLRW

SEQ ID NO: 5135 - protein, 5 aa, Artificial Sequence
  Description of Artificial Sequence: Synthetic peptide
DALLV

SEQ ID NO: 5136 - protein, 5 aa, Artificial Sequence
  Description of Artificial Sequence: Synthetic peptide
GNLNK

SEQ ID NO: 5137 - protein, 5 aa, Artificial Sequence
  Description of Artificial Sequence: Synthetic peptide
GNLRP

SEQ ID NO: 5138 - protein, 5 aa, Artificial Sequence
  Description of Artificial Sequence: Synthetic peptide
GNLRS

SEQ ID NO: 5139 - protein, 5 aa, Artificial Sequence
  Description of Artificial Sequence: Synthetic peptide
GTLIR

SEQ ID NO: 5140 - protein, 5 aa, Artificial Sequence
  Description of Artificial Sequence: Synthetic peptide
HGLET

SEQ ID NO: 5141 - protein, 5 aa, Artificial Sequence
  Description of Artificial Sequence: Synthetic peptide
HMLNR

SEQ ID NO: 5142 - protein, 5 aa, Artificial Sequence
  Description of Artificial Sequence: Synthetic peptide
KNLMR

SEQ ID NO: 5143 - protein, 5 aa, Artificial Sequence
  Description of Artificial Sequence: Synthetic peptide
PGLLG

SEQ ID NO: 5144 - protein, 5 aa, Artificial Sequence
  Description of Artificial Sequence: Synthetic peptide
RNLVR

SEQ ID NO: 5145 - protein, 5 aa, Artificial Sequence
  Description of Artificial Sequence: Synthetic peptide
SMLNR

SEQ ID NO: 5146 - protein, 5 aa, Artificial Sequence
  Description of Artificial Sequence: Synthetic peptide
TMLQR

SEQ ID NO: 5147 - protein, 5 aa, Artificial Sequence
  Description of Artificial Sequence: Synthetic peptide
AALRS

SEQ ID NO: 5148 - protein, 5 aa, Artificial Sequence
  Description of Artificial Sequence: Synthetic peptide
ADLER

SEQ ID NO: 5149 - protein, 5 aa, Artificial Sequence
  Description of Artificial Sequence: Synthetic peptide
AMLAR

SEQ ID NO: 5150 - protein, 5 aa, Artificial Sequence
  Description of Artificial Sequence: Synthetic peptide
AMLHR

SEQ ID NO: 5151 - protein, 5 aa, Artificial Sequence
  Description of Artificial Sequence: Synthetic peptide
AMLIR

SEQ ID NO: 5152 - protein, 5 aa, Artificial Sequence
  Description of Artificial Sequence: Synthetic peptide
ANFRR

SEQ ID NO: 5153 - protein, 5 aa, Artificial Sequence
  Description of Artificial Sequence: Synthetic peptide
ANIQR

SEQ ID NO: 5154 - protein, 5 aa, Artificial Sequence
  Description of Artificial Sequence: Synthetic peptide
ANLDR

SEQ ID NO: 5155 - protein, 5 aa, Artificial Sequence
  Description of Artificial Sequence: Synthetic peptide
ANLVG

SEQ ID NO: 5156 - protein, 5 aa, Artificial Sequence
  Description of Artificial Sequence: Synthetic peptide
ANSRR

SEQ ID NO: 5157 - protein, 5 aa, Artificial Sequence
  Description of Artificial Sequence: Synthetic peptide
ANVRR

SEQ ID NO: 5158 - protein, 5 aa, Artificial Sequence
  Description of Artificial Sequence: Synthetic peptide
APLRR

SEQ ID NO: 5159 - protein, 5 aa, Artificial Sequence
  Description of Artificial Sequence: Synthetic peptide
ATLRS

SEQ ID NO: 5160 - protein, 5 aa, Artificial Sequence
  Description of Artificial Sequence: Synthetic peptide
AYFRR

SEQ ID NO: 5161 - protein, 5 aa, Artificial Sequence
  Description of Artificial Sequence: Synthetic peptide
CNLAR

SEQ ID NO: 5162 - protein, 5 aa, Artificial Sequence
  Description of Artificial Sequence: Synthetic peptide
CNLNR

SEQ ID NO: 5163 - protein, 5 aa, Artificial Sequence
  Description of Artificial Sequence: Synthetic peptide
CNLVR

SEQ ID NO: 5164 - protein, 5 aa, Artificial Sequence
  Description of Artificial Sequence: Synthetic peptide
GHLNR

SEQ ID NO: 5165 - protein, 5 aa, Artificial Sequence
  Description of Artificial Sequence: Synthetic peptide
GNFRR

SEQ ID NO: 5166 - protein, 5 aa, Artificial Sequence
  Description of Artificial Sequence: Synthetic peptide
GNFVG

SEQ ID NO: 5167 - protein, 5 aa, Artificial Sequence
  Description of Artificial Sequence: Synthetic peptide
GNLAG

SEQ ID NO: 5168 - protein, 5 aa, Artificial Sequence
  Description of Artificial Sequence: Synthetic peptide
GNLAS

SEQ ID NO: 5169 - protein, 5 aa, Artificial Sequence
  Description of Artificial Sequence: Synthetic peptide
GNLHK

SEQ ID NO: 5170 - protein, 5 aa, Artificial Sequence
  Description of Artificial Sequence: Synthetic peptide
GNLLS

SEQ ID NO: 5171 - protein, 5 aa, Artificial Sequence
  Description of Artificial Sequence: Synthetic peptide
GNLMS

SEQ ID NO: 5172 - protein, 5 aa, Artificial Sequence
  Description of Artificial Sequence: Synthetic peptide
GNLNH

SEQ ID NO: 5173 - protein, 5 aa, Artificial Sequence
  Description of Artificial Sequence: Synthetic peptide
GNLQS

SEQ ID NO: 5174 - protein, 5 aa, Artificial Sequence
  Description of Artificial Sequence: Synthetic peptide
GNLRH

SEQ ID NO: 5175 - protein, 4 aa, Artificial Sequence
  Description of Artificial Sequence: Synthetic peptide
GNLS

SEQ ID NO: 5176 - protein, 5 aa, Artificial Sequence
  Description of Artificial Sequence: Synthetic peptide
GNLTK

SEQ ID NO: 5177 - protein, 5 aa, Artificial Sequence
  Description of Artificial Sequence: Synthetic peptide
GNLTQ

SEQ ID NO: 5178 - protein, 5 aa, Artificial Sequence
  Description of Artificial Sequence: Synthetic peptide
GNLTW

SEQ ID NO: 5179 - protein, 5 aa, Artificial Sequence
  Description of Artificial Sequence: Synthetic peptide
GNLVW

SEQ ID NO: 5180 - protein, 5 aa, Artificial Sequence
  Description of Artificial Sequence: Synthetic peptide
GNLWR

SEQ ID NO: 5181 - protein, 5 aa, Artificial Sequence
  Description of Artificial Sequence: Synthetic peptide
GNSKR

SEQ ID NO: 5182 - protein, 5 aa, Artificial Sequence
  Description of Artificial Sequence: Synthetic peptide
GNSQR

SEQ ID NO: 5183 - protein, 5 aa, Artificial Sequence
  Description of Artificial Sequence: Synthetic peptide
GNSRR

SEQ ID NO: 5184 - protein, 5 aa, Artificial Sequence
  Description of Artificial Sequence: Synthetic peptide
GNVQR

SEQ ID NO: 5185 - protein, 5 aa, Artificial Sequence
  Description of Artificial Sequence: Synthetic peptide
GNVTR

SEQ ID NO: 5186 - protein, 5 aa, Artificial Sequence
  Description of Artificial Sequence: Synthetic peptide
GQLAL

SEQ ID NO: 5187 - protein, 4 aa, Artificial Sequence
  Description of Artificial Sequence: Synthetic peptide
GYLR

SEQ ID NO: 5188 - protein, 5 aa, Artificial Sequence
  Description of Artificial Sequence: Synthetic peptide
ITLQR

SEQ ID NO: 5189 - protein, 5 aa, Artificial Sequence
  Description of Artificial Sequence: Synthetic peptide
KILGN

SEQ ID NO: 5190 - protein, 5 aa, Artificial Sequence
  Description of Artificial Sequence: Synthetic peptide
KNLKR

SEQ ID NO: 5191 - protein, 5 aa, Artificial Sequence
  Description of Artificial Sequence: Synthetic peptide
KSLRR

SEQ ID NO: 5192 - protein, 5 aa, Artificial Sequence
  Description of Artificial Sequence: Synthetic peptide
LNLRR

SEQ ID NO: 5193 - protein, 5 aa, Artificial Sequence
  Description of Artificial Sequence: Synthetic peptide
LNLVR

SEQ ID NO: 5194 - protein, 5 aa, Artificial Sequence
  Description of Artificial Sequence: Synthetic peptide
NNLNR

SEQ ID NO: 5195 - protein, 5 aa, Artificial Sequence
  Description of Artificial Sequence: Synthetic peptide
NNSRR

SEQ ID NO: 5196 - protein, 5 aa, Artificial Sequence
  Description of Artificial Sequence: Synthetic peptide
PRLRG

SEQ ID NO: 5197 - protein, 5 aa, Artificial Sequence
  Description of Artificial Sequence: Synthetic peptide
QHLKR

SEQ ID NO: 5198 - protein, 5 aa, Artificial Sequence
  Description of Artificial Sequence: Synthetic peptide
RLIIN

SEQ ID NO: 5199 - protein, 5 aa, Artificial Sequence
  Description of Artificial Sequence: Synthetic peptide
RNLKR

SEQ ID NO: 5200 - protein, 5 aa, Artificial Sequence
  Description of Artificial Sequence: Synthetic peptide
SHLKR

SEQ ID NO: 5201 - protein, 5 aa, Artificial Sequence
  Description of Artificial Sequence: Synthetic peptide
SKLTR

SEQ ID NO: 5202 - protein, 5 aa, Artificial Sequence
  Description of Artificial Sequence: Synthetic peptide
SMLVR

SEQ ID NO: 5203 - protein, 5 aa, Artificial Sequence
  Description of Artificial Sequence: Synthetic peptide
SNLFR

SEQ ID NO: 5204 - protein, 5 aa, Artificial Sequence
  Description of Artificial Sequence: Synthetic peptide
SNLIH

SEQ ID NO: 5205 - protein, 5 aa, Artificial Sequence
  Description of Artificial Sequence: Synthetic peptide
SNLRK

SEQ ID NO: 5206 - protein, 5 aa, Artificial Sequence
  Description of Artificial Sequence: Synthetic peptide
SNLRQ

SEQ ID NO: 5207 - protein, 5 aa, Artificial Sequence
  Description of Artificial Sequence: Synthetic peptide
SNLSG

SEQ ID NO: 5208 - protein, 5 aa, Artificial Sequence
  Description of Artificial Sequence: Synthetic peptide
SNLTS

SEQ ID NO: 5209 - protein, 5 aa, Artificial Sequence
  Description of Artificial Sequence: Synthetic peptide
SNLVW

SEQ ID NO: 5210 - protein, 5 aa, Artificial Sequence
  Description of Artificial Sequence: Synthetic peptide
SNSRR

SEQ ID NO: 5211 - protein, 5 aa, Artificial Sequence
  Description of Artificial Sequence: Synthetic peptide
SNVKR

SEQ ID NO: 5212 - protein, 5 aa, Artificial Sequence
  Description of Artificial Sequence: Synthetic peptide
SNVRG

SEQ ID NO: 5213 - protein, 5 aa, Artificial Sequence
  Description of Artificial Sequence: Synthetic peptide
TMFRR

SEQ ID NO: 5214 - protein, 5 aa, Artificial Sequence
  Description of Artificial Sequence: Synthetic peptide
TNLLS

SEQ ID NO: 5215 - protein, 5 aa, Artificial Sequence
  Description of Artificial Sequence: Synthetic peptide
TPTRS

SEQ ID NO: 5216 - protein, 5 aa, Artificial Sequence
  Description of Artificial Sequence: Synthetic peptide
TQLVL

SEQ ID NO: 5217 - protein, 5 aa, Artificial Sequence
  Description of Artificial Sequence: Synthetic peptide
VNLTR

SEQ ID NO: 5218 - protein, 5 aa, Artificial Sequence
  Description of Artificial Sequence: Synthetic peptide
AMLVR

SEQ ID NO: 5219 - protein, 5 aa, Artificial Sequence
  Description of Artificial Sequence: Synthetic peptide
GMLHR

SEQ ID NO: 5220 - protein, 5 aa, Artificial Sequence
  Description of Artificial Sequence: Synthetic peptide
GMLQR

SEQ ID NO: 5221 - protein, 5 aa, Artificial Sequence
  Description of Artificial Sequence: Synthetic peptide
HMLAR

SEQ ID NO: 5222 - protein, 5 aa, Artificial Sequence
  Description of Artificial Sequence: Synthetic peptide
RRLKN

SEQ ID NO: 5223 - protein, 5 aa, Artificial Sequence
  Description of Artificial Sequence: Synthetic peptide
AMLMR

SEQ ID NO: 5224 - protein, 5 aa, Artificial Sequence
  Description of Artificial Sequence: Synthetic peptide
GMLIR

SEQ ID NO: 5225 - protein, 5 aa, Artificial Sequence
  Description of Artificial Sequence: Synthetic peptide
EMLRR

SEQ ID NO: 5226 - protein, 5 aa, Artificial Sequence
  Description of Artificial Sequence: Synthetic peptide
RTLAL

SEQ ID NO: 5227 - protein, 5 aa, Artificial Sequence
  Description of Artificial Sequence: Synthetic peptide
SMLSR

SEQ ID NO: 5228 - protein, 5 aa, Artificial Sequence
  Description of Artificial Sequence: Synthetic peptide
TMLTR

SEQ ID NO: 5229 - protein, 5 aa, Artificial Sequence
  Description of Artificial Sequence: Synthetic peptide
TMLVR

SEQ ID NO: 5230 - protein, 5 aa, Artificial Sequence
  Description of Artificial Sequence: Synthetic peptide
TMLMR

SEQ ID NO: 5231 - protein, 5 aa, Artificial Sequence
  Description of Artificial Sequence: Synthetic peptide
GMLMR

SEQ ID NO: 5232 - protein, 5 aa, Artificial Sequence
  Description of Artificial Sequence: Synthetic peptide
AMLER

SEQ ID NO: 5233 - protein, 5 aa, Artificial Sequence
  Description of Artificial Sequence: Synthetic peptide
AMVRR

SEQ ID NO: 5234 - protein, 5 aa, Artificial Sequence
  Description of Artificial Sequence: Synthetic peptide
TMLAR

SEQ ID NO: 5235 - protein, 5 aa, Artificial Sequence
  Description of Artificial Sequence: Synthetic peptide
SMLMR

SEQ ID NO: 5236 - protein, 5 aa, Artificial Sequence
  Description of Artificial Sequence: Synthetic peptide
HLLRR

SEQ ID NO: 5237 - protein, 5 aa, Artificial Sequence
  Description of Artificial Sequence: Synthetic peptide
HMLHR

SEQ ID NO: 5238 - protein, 5 aa, Artificial Sequence
  Description of Artificial Sequence: Synthetic peptide
KTLRR

SEQ ID NO: 5239 - protein, 5 aa, Artificial Sequence
  Description of Artificial Sequence: Synthetic peptide
SMLKN

SEQ ID NO: 5240 - protein, 5 aa, Artificial Sequence
  Description of Artificial Sequence: Synthetic peptide
AMLLR

SEQ ID NO: 5241 - protein, 5 aa, Artificial Sequence
  Description of Artificial Sequence: Synthetic peptide
AMLRH

SEQ ID NO: 5242 - protein, 5 aa, Artificial Sequence
  Description of Artificial Sequence: Synthetic peptide
AMLRS

SEQ ID NO: 5243 - protein, 5 aa, Artificial Sequence
  Description of Artificial Sequence: Synthetic peptide
AMLRW

SEQ ID NO: 5244 - protein, 5 aa, Artificial Sequence
  Description of Artificial Sequence: Synthetic peptide
AMLSR

SEQ ID NO: 5245 - protein, 5 aa, Artificial Sequence
  Description of Artificial Sequence: Synthetic peptide
GMLKN

SEQ ID NO: 5246 - protein, 5 aa, Artificial Sequence
  Description of Artificial Sequence: Synthetic peptide
GMLRW

SEQ ID NO: 5247 - protein, 5 aa, Artificial Sequence
  Description of Artificial Sequence: Synthetic peptide
GMVRR

SEQ ID NO: 5248 - protein, 5 aa, Artificial Sequence
  Description of Artificial Sequence: Synthetic peptide
HILRR

SEQ ID NO: 5249 - protein, 5 aa, Artificial Sequence
  Description of Artificial Sequence: Synthetic peptide
HMLRS

SEQ ID NO: 5250 - protein, 5 aa, Artificial Sequence
  Description of Artificial Sequence: Synthetic peptide
MGLST

SEQ ID NO: 5251 - protein, 5 aa, Artificial Sequence
  Description of Artificial Sequence: Synthetic peptide
NMLIR

SEQ ID NO: 5252 - protein, 5 aa, Artificial Sequence
  Description of Artificial Sequence: Synthetic peptide
RMLKR

SEQ ID NO: 5253 - protein, 5 aa, Artificial Sequence
  Description of Artificial Sequence: Synthetic peptide
RMLQR

SEQ ID NO: 5254 - protein, 5 aa, Artificial Sequence
  Description of Artificial Sequence: Synthetic peptide
SMFKR

SEQ ID NO: 5255 - protein, 5 aa, Artificial Sequence
  Description of Artificial Sequence: Synthetic peptide
TLLRR

SEQ ID NO: 5256 - protein, 5 aa, Artificial Sequence
  Description of Artificial Sequence: Synthetic peptide
TMIRR

SEQ ID NO: 5257 - protein, 5 aa, Artificial Sequence
  Description of Artificial Sequence: Synthetic peptide
TMVRR

SEQ ID NO: 5258 - protein, 4 aa, Artificial Sequence
  Description of Artificial Sequence: Synthetic peptide
VIKR

SEQ ID NO: 5259 - protein, 5 aa, Artificial Sequence
  Description of Artificial Sequence: Synthetic peptide
AKLQR

SEQ ID NO: 5260 - protein, 5 aa, Artificial Sequence
  Description of Artificial Sequence: Synthetic peptide
AMFRR

SEQ ID NO: 5261 - protein, 5 aa, Artificial Sequence
  Description of Artificial Sequence: Synthetic peptide
AMIRR

SEQ ID NO: 5262 - protein, 5 aa, Artificial Sequence
  Description of Artificial Sequence: Synthetic peptide
AMITR

SEQ ID NO: 5263 - protein, 5 aa, Artificial Sequence
  Description of Artificial Sequence: Synthetic peptide
AMKTR

SEQ ID NO: 5264 - protein, 5 aa, Artificial Sequence
  Description of Artificial Sequence: Synthetic peptide
AMLCR

SEQ ID NO: 5265 - protein, 5 aa, Artificial Sequence
  Description of Artificial Sequence: Synthetic peptide
AMLHS

SEQ ID NO: 5266 - protein, 5 aa, Artificial Sequence
  Description of Artificial Sequence: Synthetic peptide
AMLPR

SEQ ID NO: 5267 - protein, 5 aa, Artificial Sequence
  Description of Artificial Sequence: Synthetic peptide
AMLRK

SEQ ID NO: 5268 - protein, 5 aa, Artificial Sequence
  Description of Artificial Sequence: Synthetic peptide
AMLTM

SEQ ID NO: 5269 - protein, 5 aa, Artificial Sequence
  Description of Artificial Sequence: Synthetic peptide
AMLWR

SEQ ID NO: 5270 - protein, 4 aa, Artificial Sequence
  Description of Artificial Sequence: Synthetic peptide
AMYT

SEQ ID NO: 5271 - protein, 5 aa, Artificial Sequence
  Description of Artificial Sequence: Synthetic peptide
ARLRR

SEQ ID NO: 5272 - protein, 5 aa, Artificial Sequence
  Description of Artificial Sequence: Synthetic peptide
CMLRR

SEQ ID NO: 5273 - protein, 5 aa, Artificial Sequence
  Description of Artificial Sequence: Synthetic peptide
DMVKR

SEQ ID NO: 5274 - protein, 5 aa, Artificial Sequence
  Description of Artificial Sequence: Synthetic peptide
EMLNS

SEQ ID NO: 5275 - protein, 5 aa, Artificial Sequence
  Description of Artificial Sequence: Synthetic peptide
GLLKR

SEQ ID NO: 5276 - protein, 5 aa, Artificial Sequence
  Description of Artificial Sequence: Synthetic peptide
GLLQS

SEQ ID NO: 5277 - protein, 5 aa, Artificial Sequence
  Description of Artificial Sequence: Synthetic peptide
GLLSR

SEQ ID NO: 5278 - protein, 5 aa, Artificial Sequence
  Description of Artificial Sequence: Synthetic peptide
GMIKR

SEQ ID NO: 5279 - protein, 5 aa, Artificial Sequence
  Description of Artificial Sequence: Synthetic peptide
GMLKT

SEQ ID NO: 5280 - protein, 5 aa, Artificial Sequence
  Description of Artificial Sequence: Synthetic peptide
GMLRM

SEQ ID NO: 5281 - protein, 5 aa, Artificial Sequence
  Description of Artificial Sequence: Synthetic peptide
GMLTW

SEQ ID NO: 5282 - protein, 5 aa, Artificial Sequence
  Description of Artificial Sequence: Synthetic peptide
GRLKR

SEQ ID NO: 5283 - protein, 5 aa, Artificial Sequence
  Description of Artificial Sequence: Synthetic peptide
GRLKS

SEQ ID NO: 5284 - protein, 5 aa, Artificial Sequence
  Description of Artificial Sequence: Synthetic peptide
GRLRV

SEQ ID NO: 5285 - protein, 5 aa, Artificial Sequence
  Description of Artificial Sequence: Synthetic peptide
HLLNS

SEQ ID NO: 5286 - protein, 5 aa, Artificial Sequence
  Description of Artificial Sequence: Synthetic peptide
HMLLR

SEQ ID NO: 5287 - protein, 5 aa, Artificial Sequence
  Description of Artificial Sequence: Synthetic peptide
HMLMR

SEQ ID NO: 5288 - protein, 5 aa, Artificial Sequence
  Description of Artificial Sequence: Synthetic peptide
HMVRR

SEQ ID NO: 5289 - protein, 5 aa, Artificial Sequence
  Description of Artificial Sequence: Synthetic peptide
KMLKR

SEQ ID NO: 5290 - protein, 5 aa, Artificial Sequence
  Description of Artificial Sequence: Synthetic peptide
LMLGK

SEQ ID NO: 5291 - protein, 4 aa, Artificial Sequence
  Description of Artificial Sequence: Synthetic peptide
MLRR

SEQ ID NO: 5292 - protein, 5 aa, Artificial Sequence
  Description of Artificial Sequence: Synthetic peptide
NLLKR

SEQ ID NO: 5293 - protein, 5 aa, Artificial Sequence
  Description of Artificial Sequence: Synthetic peptide
NMLGR

SEQ ID NO: 5294 - protein, 5 aa, Artificial Sequence
  Description of Artificial Sequence: Synthetic peptide
NTFRR

SEQ ID NO: 5295 - protein, 5 aa, Artificial Sequence
  Description of Artificial Sequence: Synthetic peptide
PMLMR

SEQ ID NO: 5296 - protein, 5 aa, Artificial Sequence
  Description of Artificial Sequence: Synthetic peptide
PVVKR

SEQ ID NO: 5297 - protein, 5 aa, Artificial Sequence
  Description of Artificial Sequence: Synthetic peptide
RMFRR

SEQ ID NO: 5298 - protein, 5 aa, Artificial Sequence
  Description of Artificial Sequence: Synthetic peptide
RMLRR

SEQ ID NO: 5299 - protein, 5 aa, Artificial Sequence
  Description of Artificial Sequence: Synthetic peptide
SLLNR

SEQ ID NO: 5300 - protein, 5 aa, Artificial Sequence
  Description of Artificial Sequence: Synthetic peptide
SMFRR

SEQ ID NO: 5301 - protein, 5 aa, Artificial Sequence
  Description of Artificial Sequence: Synthetic peptide
SMIKR

SEQ ID NO: 5302 - protein, 5 aa, Artificial Sequence
  Description of Artificial Sequence: Synthetic peptide
SMLGR

SEQ ID NO: 5303 - protein, 5 aa, Artificial Sequence
  Description of Artificial Sequence: Synthetic peptide
SMLKW

SEQ ID NO: 5304 - protein, 5 aa, Artificial Sequence
  Description of Artificial Sequence: Synthetic peptide
SMSRR

SEQ ID NO: 5305 - protein, 5 aa, Artificial Sequence
  Description of Artificial Sequence: Synthetic peptide
SMVKR

SEQ ID NO: 5306 - protein, 5 aa, Artificial Sequence
  Description of Artificial Sequence: Synthetic peptide
SRLRR

SEQ ID NO: 5307 - protein, 5 aa, Artificial Sequence
  Description of Artificial Sequence: Synthetic peptide
TILRR

SEQ ID NO: 5308 - protein, 5 aa, Artificial Sequence
  Description of Artificial Sequence: Synthetic peptide
TMLER

SEQ ID NO: 5309 - protein, 5 aa, Artificial Sequence
  Description of Artificial Sequence: Synthetic peptide
TMLGR

SEQ ID NO: 5310 - protein, 5 aa, Artificial Sequence
  Description of Artificial Sequence: Synthetic peptide
TMLHR

SEQ ID NO: 5311 - protein, 5 aa, Artificial Sequence
  Description of Artificial Sequence: Synthetic peptide
TMLLR

SEQ ID NO: 5312 - protein, 5 aa, Artificial Sequence
  Description of Artificial Sequence: Synthetic peptide
TMLRH

SEQ ID NO: 5313 - protein, 5 aa, Artificial Sequence
  Description of Artificial Sequence: Synthetic peptide
TMLWR

SEQ ID NO: 5314 - protein, 5 aa, Artificial Sequence
  Description of Artificial Sequence: Synthetic peptide
VMLKR

SEQ ID NO: 5315 - protein, 5 aa, Artificial Sequence
  Description of Artificial Sequence: Synthetic peptide
VSLRK

SEQ ID NO: 5316 - protein, 5 aa, Artificial Sequence
  Description of Artificial Sequence: Synthetic peptide
WMLKR

SEQ ID NO: 5317 - protein, 5 aa, Artificial Sequence
  Description of Artificial Sequence: Synthetic peptide
WMLRR

SEQ ID NO: 5318 - protein, 5 aa, Artificial Sequence
  Description of Artificial Sequence: Synthetic peptide
YMLKR

SEQ ID NO: 5319 - protein, 5 aa, Artificial Sequence
  Description of Artificial Sequence: Synthetic peptide
YMLRR

SEQ ID NO: 5320 - protein, 5 aa, Artificial Sequence
  Description of Artificial Sequence: Synthetic peptide
ATLRK

SEQ ID NO: 5321 - protein, 5 aa, Artificial Sequence
  Description of Artificial Sequence: Synthetic peptide
RTLQR

SEQ ID NO: 5322 - protein, 5 aa, Artificial Sequence
  Description of Artificial Sequence: Synthetic peptide
KTLER

SEQ ID NO: 5323 - protein, 5 aa, Artificial Sequence
  Description of Artificial Sequence: Synthetic peptide
QTLMR

SEQ ID NO: 5324 - protein, 5 aa, Artificial Sequence
  Description of Artificial Sequence: Synthetic peptide
KTLQR

SEQ ID NO: 5325 - protein, 5 aa, Artificial Sequence
  Description of Artificial Sequence: Synthetic peptide
RTLRR

SEQ ID NO: 5326 - protein, 5 aa, Artificial Sequence
  Description of Artificial Sequence: Synthetic peptide
HILNR

SEQ ID NO: 5327 - protein, 5 aa, Artificial Sequence
  Description of Artificial Sequence: Synthetic peptide
MTLMR

SEQ ID NO: 5328 - protein, 5 aa, Artificial Sequence
  Description of Artificial Sequence: Synthetic peptide
RTLKR

SEQ ID NO: 5329 - protein, 5 aa, Artificial Sequence
  Description of Artificial Sequence: Synthetic peptide
ATVRR

SEQ ID NO: 5330 - protein, 5 aa, Artificial Sequence
  Description of Artificial Sequence: Synthetic peptide
GVLSR

SEQ ID NO: 5331 - protein, 5 aa, Artificial Sequence
  Description of Artificial Sequence: Synthetic peptide
HRLKI

SEQ ID NO: 5332 - protein, 5 aa, Artificial Sequence
  Description of Artificial Sequence: Synthetic peptide
KTLIR

SEQ ID NO: 5333 - protein, 5 aa, Artificial Sequence
  Description of Artificial Sequence: Synthetic peptide
TILAR

SEQ ID NO: 5334 - protein, 5 aa, Artificial Sequence
  Description of Artificial Sequence: Synthetic peptide
ASLHR

SEQ ID NO: 5335 - protein, 5 aa, Artificial Sequence
  Description of Artificial Sequence: Synthetic peptide
ATLNK

SEQ ID NO: 5336 - protein, 5 aa, Artificial Sequence
  Description of Artificial Sequence: Synthetic peptide
ATLRG

SEQ ID NO: 5337 - protein, 5 aa, Artificial Sequence
  Description of Artificial Sequence: Synthetic peptide
GPLVR

SEQ ID NO: 5338 - protein, 5 aa, Artificial Sequence
  Description of Artificial Sequence: Synthetic peptide
HVLNR

SEQ ID NO: 5339 - protein, 5 aa, Artificial Sequence
  Description of Artificial Sequence: Synthetic peptide
NSLKR

SEQ ID NO: 5340 - protein, 5 aa, Artificial Sequence
  Description of Artificial Sequence: Synthetic peptide
NTLMR

SEQ ID NO: 5341 - protein, 5 aa, Artificial Sequence
  Description of Artificial Sequence: Synthetic peptide
NVLRR

SEQ ID NO: 5342 - protein, 5 aa, Artificial Sequence
  Description of Artificial Sequence: Synthetic peptide
RRLNR

SEQ ID NO: 5343 - protein, 5 aa, Artificial Sequence
  Description of Artificial Sequence: Synthetic peptide
ARLKI

SEQ ID NO: 5344 - protein, 5 aa, Artificial Sequence
  Description of Artificial Sequence: Synthetic peptide
ATFRR

SEQ ID NO: 5345 - protein, 5 aa, Artificial Sequence
  Description of Artificial Sequence: Synthetic peptide
ATLNW

SEQ ID NO: 5346 - protein, 5 aa, Artificial Sequence
  Description of Artificial Sequence: Synthetic peptide
ATLRW

SEQ ID NO: 5347 - protein, 5 aa, Artificial Sequence
  Description of Artificial Sequence: Synthetic peptide
IALAG

SEQ ID NO: 5348 - protein, 5 aa, Artificial Sequence
  Description of Artificial Sequence: Synthetic peptide
MSLRR

SEQ ID NO: 5349 - protein, 5 aa, Artificial Sequence
  Description of Artificial Sequence: Synthetic peptide
MTLLR

SEQ ID NO: 5350 - protein, 5 aa, Artificial Sequence
  Description of Artificial Sequence: Synthetic peptide
MTLVR

SEQ ID NO: 5351 - protein, 5 aa, Artificial Sequence
  Description of Artificial Sequence: Synthetic peptide
QRLSV

SEQ ID NO: 5352 - protein, 5 aa, Artificial Sequence
  Description of Artificial Sequence: Synthetic peptide
RRIDR

SEQ ID NO: 5353 - protein, 5 aa, Artificial Sequence
  Description of Artificial Sequence: Synthetic peptide
RRLDS

SEQ ID NO: 5354 - protein, 5 aa, Artificial Sequence
  Description of Artificial Sequence: Synthetic peptide
RRVDR

SEQ ID NO: 5355 - protein, 5 aa, Artificial Sequence
  Description of Artificial Sequence: Synthetic peptide
RSLIR

SEQ ID NO: 5356 - protein, 5 aa, Artificial Sequence
  Description of Artificial Sequence: Synthetic peptide
RTLIR

SEQ ID NO: 5357 - protein, 5 aa, Artificial Sequence
  Description of Artificial Sequence: Synthetic peptide
SDLTV

SEQ ID NO: 5358 - protein, 5 aa, Artificial Sequence
  Description of Artificial Sequence: Synthetic peptide
SRLKI

SEQ ID NO: 5359 - protein, 5 aa, Artificial Sequence
  Description of Artificial Sequence: Synthetic peptide
STVRR

SEQ ID NO: 5360 - protein, 5 aa, Artificial Sequence
  Description of Artificial Sequence: Synthetic peptide
AALNS

SEQ ID NO: 5361 - protein, 5 aa, Artificial Sequence
  Description of Artificial Sequence: Synthetic peptide
AAVRR

SEQ ID NO: 5362 - protein, 5 aa, Artificial Sequence
  Description of Artificial Sequence: Synthetic peptide
APLHR

SEQ ID NO: 5363 - protein, 5 aa, Artificial Sequence
  Description of Artificial Sequence: Synthetic peptide
APLKR

SEQ ID NO: 5364 - protein, 5 aa, Artificial Sequence
  Description of Artificial Sequence: Synthetic peptide
APLMR

SEQ ID NO: 5365 - protein, 5 aa, Artificial Sequence
  Description of Artificial Sequence: Synthetic peptide
APLVR

SEQ ID NO: 5366 - protein, 4 aa, Artificial Sequence
  Description of Artificial Sequence: Synthetic peptide
APYP

SEQ ID NO: 5367 - protein, 5 aa, Artificial Sequence
  Description of Artificial Sequence: Synthetic peptide
ARLVG

SEQ ID NO: 5368 - protein, 5 aa, Artificial Sequence
  Description of Artificial Sequence: Synthetic peptide
ASFRR

SEQ ID NO: 5369 - protein, 5 aa, Artificial Sequence
  Description of Artificial Sequence: Synthetic peptide
ASLER

SEQ ID NO: 5370 - protein, 5 aa, Artificial Sequence
  Description of Artificial Sequence: Synthetic peptide
ATFKR

SEQ ID NO: 5371 - protein, 5 aa, Artificial Sequence
  Description of Artificial Sequence: Synthetic peptide
ATFRT

SEQ ID NO: 5372 - protein, 5 aa, Artificial Sequence
  Description of Artificial Sequence: Synthetic peptide
ATFTR

SEQ ID NO: 5373 - protein, 5 aa, Artificial Sequence
  Description of Artificial Sequence: Synthetic peptide
ATIRR

SEQ ID NO: 5374 - protein, 5 aa, Artificial Sequence
  Description of Artificial Sequence: Synthetic peptide
ATLES

SEQ ID NO: 5375 - protein, 5 aa, Artificial Sequence
  Description of Artificial Sequence: Synthetic peptide
ATLFR

SEQ ID NO: 5376 - protein, 5 aa, Artificial Sequence
  Description of Artificial Sequence: Synthetic peptide
ATLHW

SEQ ID NO: 5377 - protein, 5 aa, Artificial Sequence
  Description of Artificial Sequence: Synthetic peptide
ATLIS

SEQ ID NO: 5378 - protein, 5 aa, Artificial Sequence
  Description of Artificial Sequence: Synthetic peptide
ATLNH

SEQ ID NO: 5379 - protein, 5 aa, Artificial Sequence
  Description of Artificial Sequence: Synthetic peptide
ATLNS

SEQ ID NO: 5380 - protein, 5 aa, Artificial Sequence
  Description of Artificial Sequence: Synthetic peptide
ATLQG

SEQ ID NO: 5381 - protein, 5 aa, Artificial Sequence
  Description of Artificial Sequence: Synthetic peptide
ATLQW

SEQ ID NO: 5382 - protein, 5 aa, Artificial Sequence
  Description of Artificial Sequence: Synthetic peptide
ATLRI

SEQ ID NO: 5383 - protein, 5 aa, Artificial Sequence
  Description of Artificial Sequence: Synthetic peptide
ATLRP

SEQ ID NO: 5384 - protein, 5 aa, Artificial Sequence
  Description of Artificial Sequence: Synthetic peptide
ATLWR

SEQ ID NO: 5385 - protein, 5 aa, Artificial Sequence
  Description of Artificial Sequence: Synthetic peptide
ATSVR

SEQ ID NO: 5386 - protein, 5 aa, Artificial Sequence
  Description of Artificial Sequence: Synthetic peptide
ATVAR

SEQ ID NO: 5387 - protein, 5 aa, Artificial Sequence
  Description of Artificial Sequence: Synthetic peptide
AVLGR

SEQ ID NO: 5388 - protein, 5 aa, Artificial Sequence
  Description of Artificial Sequence: Synthetic peptide
AVLLR

SEQ ID NO: 5389 - protein, 5 aa, Artificial Sequence
  Description of Artificial Sequence: Synthetic peptide
AVLNR

SEQ ID NO: 5390 - protein, 5 aa, Artificial Sequence
  Description of Artificial Sequence: Synthetic peptide
DRLRA

SEQ ID NO: 5391 - protein, 5 aa, Artificial Sequence
  Description of Artificial Sequence: Synthetic peptide
EPLVM

SEQ ID NO: 5392 - protein, 5 aa, Artificial Sequence
  Description of Artificial Sequence: Synthetic peptide
GPFKR

SEQ ID NO: 5393 - protein, 5 aa, Artificial Sequence
  Description of Artificial Sequence: Synthetic peptide
GPLGL

SEQ ID NO: 5394 - protein, 5 aa, Artificial Sequence
  Description of Artificial Sequence: Synthetic peptide
GPLKR

SEQ ID NO: 5395 - protein, 5 aa, Artificial Sequence
  Description of Artificial Sequence: Synthetic peptide
GSLGA

SEQ ID NO: 5396 - protein, 5 aa, Artificial Sequence
  Description of Artificial Sequence: Synthetic peptide
GTFRR

SEQ ID NO: 5397 - protein, 5 aa, Artificial Sequence
  Description of Artificial Sequence: Synthetic peptide
GTLMW

SEQ ID NO: 5398 - protein, 5 aa, Artificial Sequence
  Description of Artificial Sequence: Synthetic peptide
GTLRK

SEQ ID NO: 5399 - protein, 5 aa, Artificial Sequence
  Description of Artificial Sequence: Synthetic peptide
GTSNR

SEQ ID NO: 5400 - protein, 5 aa, Artificial Sequence
  Description of Artificial Sequence: Synthetic peptide
GTSRR

SEQ ID NO: 5401 - protein, 5 aa, Artificial Sequence
  Description of Artificial Sequence: Synthetic peptide
GVLRK

SEQ ID NO: 5402 - protein, 5 aa, Artificial Sequence
  Description of Artificial Sequence: Synthetic peptide
GVVRR

SEQ ID NO: 5403 - protein, 5 aa, Artificial Sequence
  Description of Artificial Sequence: Synthetic peptide
HILQR

SEQ ID NO: 5404 - protein, 5 aa, Artificial Sequence
  Description of Artificial Sequence: Synthetic peptide
KTLLR

SEQ ID NO: 5405 - protein, 5 aa, Artificial Sequence
  Description of Artificial Sequence: Synthetic peptide
KTLVR

SEQ ID NO: 5406 - protein, 5 aa, Artificial Sequence
  Description of Artificial Sequence: Synthetic peptide
MALRM

SEQ ID NO: 5407 - protein, 5 aa, Artificial Sequence
  Description of Artificial Sequence: Synthetic peptide
MPLAR

SEQ ID NO: 5408 - protein, 5 aa, Artificial Sequence
  Description of Artificial Sequence: Synthetic peptide
MPLVR

SEQ ID NO: 5409 - protein, 5 aa, Artificial Sequence
  Description of Artificial Sequence: Synthetic peptide
NTLRW

SEQ ID NO: 5410 - protein, 5 aa, Artificial Sequence
  Description of Artificial Sequence: Synthetic peptide
NTLVS

SEQ ID NO: 5411 - protein, 5 aa, Artificial Sequence
  Description of Artificial Sequence: Synthetic peptide
NTVRR

SEQ ID NO: 5412 - protein, 5 aa, Artificial Sequence
  Description of Artificial Sequence: Synthetic peptide
PPLKR

SEQ ID NO: 5413 - protein, 5 aa, Artificial Sequence
  Description of Artificial Sequence: Synthetic peptide
PSLKR

SEQ ID NO: 5414 - protein, 5 aa, Artificial Sequence
  Description of Artificial Sequence: Synthetic peptide
PTFHR

SEQ ID NO: 5415 - protein, 4 aa, Artificial Sequence
  Description of Artificial Sequence: Synthetic peptide
QKLA

SEQ ID NO: 5416 - protein, 5 aa, Artificial Sequence
  Description of Artificial Sequence: Synthetic peptide
QTLIR

SEQ ID NO: 5417 - protein, 5 aa, Artificial Sequence
  Description of Artificial Sequence: Synthetic peptide
QTLRQ

SEQ ID NO: 5418 - protein, 5 aa, Artificial Sequence
  Description of Artificial Sequence: Synthetic peptide
RRLAG

SEQ ID NO: 5419 - protein, 5 aa, Artificial Sequence
  Description of Artificial Sequence: Synthetic peptide
RRLAR

SEQ ID NO: 5420 - protein, 5 aa, Artificial Sequence
  Description of Artificial Sequence: Synthetic peptide
RRLDG

SEQ ID NO: 5421 - protein, 5 aa, Artificial Sequence
  Description of Artificial Sequence: Synthetic peptide
RRLHR

SEQ ID NO: 5422 - protein, 5 aa, Artificial Sequence
  Description of Artificial Sequence: Synthetic peptide
RRLVR

SEQ ID NO: 5423 - protein, 5 aa, Artificial Sequence
  Description of Artificial Sequence: Synthetic peptide
RRSDR

SEQ ID NO: 5424 - protein, 5 aa, Artificial Sequence
  Description of Artificial Sequence: Synthetic peptide
RRVEK

SEQ ID NO: 5425 - protein, 5 aa, Artificial Sequence
  Description of Artificial Sequence: Synthetic peptide
RTLER

SEQ ID NO: 5426 - protein, 5 aa, Artificial Sequence
  Description of Artificial Sequence: Synthetic peptide
RTLNR

SEQ ID NO: 5427 - protein, 5 aa, Artificial Sequence
  Description of Artificial Sequence: Synthetic peptide
RTLRG

SEQ ID NO: 5428 - protein, 5 aa, Artificial Sequence
  Description of Artificial Sequence: Synthetic peptide
SAVKR

SEQ ID NO: 5429 - protein, 5 aa, Artificial Sequence
  Description of Artificial Sequence: Synthetic peptide
SPLRR

SEQ ID NO: 5430 - protein, 5 aa, Artificial Sequence
  Description of Artificial Sequence: Synthetic peptide
SRLRI

SEQ ID NO: 5431 - protein, 5 aa, Artificial Sequence
  Description of Artificial Sequence: Synthetic peptide
STLCR

SEQ ID NO: 5432 - protein, 5 aa, Artificial Sequence
  Description of Artificial Sequence: Synthetic peptide
STLKS

SEQ ID NO: 5433 - protein, 5 aa, Artificial Sequence
  Description of Artificial Sequence: Synthetic peptide
STLRI

SEQ ID NO: 5434 - protein, 5 aa, Artificial Sequence
  Description of Artificial Sequence: Synthetic peptide
STSRR

SEQ ID NO: 5435 - protein, 5 aa, Artificial Sequence
  Description of Artificial Sequence: Synthetic peptide
SVLRK

SEQ ID NO: 5436 - protein, 5 aa, Artificial Sequence
  Description of Artificial Sequence: Synthetic peptide
TALIR

SEQ ID NO: 5437 - protein, 5 aa, Artificial Sequence
  Description of Artificial Sequence: Synthetic peptide
TALMR

SEQ ID NO: 5438 - protein, 5 aa, Artificial Sequence
  Description of Artificial Sequence: Synthetic peptide
TMLRG

SEQ ID NO: 5439 - protein, 5 aa, Artificial Sequence
  Description of Artificial Sequence: Synthetic peptide
TPIMM

SEQ ID NO: 5440 - protein, 4 aa, Artificial Sequence
  Description of Artificial Sequence: Synthetic peptide
TRSP

SEQ ID NO: 5441 - protein, 5 aa, Artificial Sequence
  Description of Artificial Sequence: Synthetic peptide
TTLRS

SEQ ID NO: 5442 - protein, 5 aa, Artificial Sequence
  Description of Artificial Sequence: Synthetic peptide
TVLNR

SEQ ID NO: 5443 - protein, 5 aa, Artificial Sequence
  Description of Artificial Sequence: Synthetic peptide
VTLQR

SEQ ID NO: 5444 - protein, 5 aa, Artificial Sequence
  Description of Artificial Sequence: Synthetic peptide
VVLGN

SEQ ID NO: 5445 - protein, 5 aa, Artificial Sequence
  Description of Artificial Sequence: Synthetic peptide
WRLDR

SEQ ID NO: 5446 - protein, 5 aa, Artificial Sequence
  Description of Artificial Sequence: Synthetic peptide
WTLRR

SEQ ID NO: 5447 - protein, 5 aa, Artificial Sequence
  Description of Artificial Sequence: Synthetic peptide
GQLVV

SEQ ID NO: 5448 - protein, 5 aa, Artificial Sequence
  Description of Artificial Sequence: Synthetic peptide
AELIV

SEQ ID NO: 5449 - protein, 5 aa, Artificial Sequence
  Description of Artificial Sequence: Synthetic peptide
TELIV

SEQ ID NO: 5450 - protein, 5 aa, Artificial Sequence
  Description of Artificial Sequence: Synthetic peptide
QELLV

SEQ ID NO: 5451 - protein, 5 aa, Artificial Sequence
  Description of Artificial Sequence: Synthetic peptide
GELIV

SEQ ID NO: 5452 - protein, 5 aa, Artificial Sequence
  Description of Artificial Sequence: Synthetic peptide
GELTV

SEQ ID NO: 5453 - protein, 5 aa, Artificial Sequence
  Description of Artificial Sequence: Synthetic peptide
QELLT

SEQ ID NO: 5454 - protein, 5 aa, Artificial Sequence
  Description of Artificial Sequence: Synthetic peptide
SELIV

SEQ ID NO: 5455 - protein, 5 aa, Artificial Sequence
  Description of Artificial Sequence: Synthetic peptide
GQLLV

SEQ ID NO: 5456 - protein, 5 aa, Artificial Sequence
  Description of Artificial Sequence: Synthetic peptide
SGLIV

SEQ ID NO: 5457 - protein, 5 aa, Artificial Sequence
  Description of Artificial Sequence: Synthetic peptide
GQLII

SEQ ID NO: 5458 - protein, 5 aa, Artificial Sequence
  Description of Artificial Sequence: Synthetic peptide
AELLV

SEQ ID NO: 5459 - protein, 5 aa, Artificial Sequence
  Description of Artificial Sequence: Synthetic peptide
VELLI

SEQ ID NO: 5460 - protein, 5 aa, Artificial Sequence
  Description of Artificial Sequence: Synthetic peptide
AELVV

SEQ ID NO: 5461 - protein, 5 aa, Artificial Sequence
  Description of Artificial Sequence: Synthetic peptide
AQLIV

SEQ ID NO: 5462 - protein, 5 aa, Artificial Sequence
  Description of Artificial Sequence: Synthetic peptide
SQLII

SEQ ID NO: 5463 - protein, 5 aa, Artificial Sequence
  Description of Artificial Sequence: Synthetic peptide
AGLIV

SEQ ID NO: 5464 - protein, 5 aa, Artificial Sequence
  Description of Artificial Sequence: Synthetic peptide
QELVV

SEQ ID NO: 5465 - protein, 5 aa, Artificial Sequence
  Description of Artificial Sequence: Synthetic peptide
GELLV

SEQ ID NO: 5466 - protein, 5 aa, Artificial Sequence
  Description of Artificial Sequence: Synthetic peptide
SQLLV

SEQ ID NO: 5467 - protein, 5 aa, Artificial Sequence
  Description of Artificial Sequence: Synthetic peptide
GELVI

SEQ ID NO: 5468 - protein, 5 aa, Artificial Sequence
  Description of Artificial Sequence: Synthetic peptide
QELII

SEQ ID NO: 5469 - protein, 5 aa, Artificial Sequence
  Description of Artificial Sequence: Synthetic peptide
TQLIV

SEQ ID NO: 5470 - protein, 5 aa, Artificial Sequence
  Description of Artificial Sequence: Synthetic peptide
VELII

SEQ ID NO: 5471 - protein, 5 aa, Artificial Sequence
  Description of Artificial Sequence: Synthetic peptide
VELLV

SEQ ID NO: 5472 - protein, 5 aa, Artificial Sequence
  Description of Artificial Sequence: Synthetic peptide
GELLI

SEQ ID NO: 5473 - protein, 5 aa, Artificial Sequence
  Description of Artificial Sequence: Synthetic peptide
NELLI

SEQ ID NO: 5474 - protein, 5 aa, Artificial Sequence
  Description of Artificial Sequence: Synthetic peptide
GQLLI

SEQ ID NO: 5475 - protein, 5 aa, Artificial Sequence
  Description of Artificial Sequence: Synthetic peptide
SQLLI

SEQ ID NO: 5476 - protein, 5 aa, Artificial Sequence
  Description of Artificial Sequence: Synthetic peptide
AQLLV

SEQ ID NO: 5477 - protein, 5 aa, Artificial Sequence
  Description of Artificial Sequence: Synthetic peptide
GQLIT

SEQ ID NO: 5478 - protein, 5 aa, Artificial Sequence
  Description of Artificial Sequence: Synthetic peptide
GQLTI

SEQ ID NO: 5479 - protein, 5 aa, Artificial Sequence
  Description of Artificial Sequence: Synthetic peptide
TELIT

SEQ ID NO: 5480 - protein, 5 aa, Artificial Sequence
  Description of Artificial Sequence: Synthetic peptide
TELLI

SEQ ID NO: 5481 - protein, 5 aa, Artificial Sequence
  Description of Artificial Sequence: Synthetic peptide
TELLV

SEQ ID NO: 5482 - protein, 5 aa, Artificial Sequence
  Description of Artificial Sequence: Synthetic peptide
QELLI

SEQ ID NO: 5483 - protein, 5 aa, Artificial Sequence
  Description of Artificial Sequence: Synthetic peptide
AQLVV

SEQ ID NO: 5484 - protein, 5 aa, Artificial Sequence
  Description of Artificial Sequence: Synthetic peptide
GSLLV

SEQ ID NO: 5485 - protein, 5 aa, Artificial Sequence
  Description of Artificial Sequence: Synthetic peptide
AQLLI

SEQ ID NO: 5486 - protein, 5 aa, Artificial Sequence
  Description of Artificial Sequence: Synthetic peptide
HPPEE

SEQ ID NO: 5487 - protein, 5 aa, Artificial Sequence
  Description of Artificial Sequence: Synthetic peptide
SQLVV

SEQ ID NO: 5488 - protein, 5 aa, Artificial Sequence
  Description of Artificial Sequence: Synthetic peptide
QELIV

SEQ ID NO: 5489 - protein, 5 aa, Artificial Sequence
  Description of Artificial Sequence: Synthetic peptide
SELII

SEQ ID NO: 5490 - protein, 5 aa, Artificial Sequence
  Description of Artificial Sequence: Synthetic peptide
AQLII

SEQ ID NO: 5491 - protein, 5 aa, Artificial Sequence
  Description of Artificial Sequence: Synthetic peptide
QQLVV

SEQ ID NO: 5492 - protein, 5 aa, Artificial Sequence
  Description of Artificial Sequence: Synthetic peptide
TGLLV

SEQ ID NO: 5493 - protein, 5 aa, Artificial Sequence
  Description of Artificial Sequence: Synthetic peptide
NQLII

SEQ ID NO: 5494 - protein, 5 aa, Artificial Sequence
  Description of Artificial Sequence: Synthetic peptide
GQLVI

SEQ ID NO: 5495 - protein, 5 aa, Artificial Sequence
  Description of Artificial Sequence: Synthetic peptide
AGLLV

SEQ ID NO: 5496 - protein, 5 aa, Artificial Sequence
  Description of Artificial Sequence: Synthetic peptide
NQLLV

SEQ ID NO: 5497 - protein, 5 aa, Artificial Sequence
  Description of Artificial Sequence: Synthetic peptide
QELGV

SEQ ID NO: 5498 - protein, 5 aa, Artificial Sequence
  Description of Artificial Sequence: Synthetic peptide
GALVV

SEQ ID NO: 5499 - protein, 5 aa, Artificial Sequence
  Description of Artificial Sequence: Synthetic peptide
SQLTV

SEQ ID NO: 5500 - protein, 5 aa, Artificial Sequence
  Description of Artificial Sequence: Synthetic peptide
GELTT

SEQ ID NO: 5501 - protein, 5 aa, Artificial Sequence
  Description of Artificial Sequence: Synthetic peptide
GELII

SEQ ID NO: 5502 - protein, 5 aa, Artificial Sequence
  Description of Artificial Sequence: Synthetic peptide
AELII

SEQ ID NO: 5503 - protein, 5 aa, Artificial Sequence
  Description of Artificial Sequence: Synthetic peptide
TQLII

SEQ ID NO: 5504 - protein, 5 aa, Artificial Sequence
  Description of Artificial Sequence: Synthetic peptide
QQLII

SEQ ID NO: 5505 - protein, 5 aa, Artificial Sequence
  Description of Artificial Sequence: Synthetic peptide
AQLIT

SEQ ID NO: 5506 - protein, 5 aa, Artificial Sequence
  Description of Artificial Sequence: Synthetic peptide
SQLIT

SEQ ID NO: 5507 - protein, 5 aa, Artificial Sequence
  Description of Artificial Sequence: Synthetic peptide
SSLIV

SEQ ID NO: 5508 - protein, 5 aa, Artificial Sequence
  Description of Artificial Sequence: Synthetic peptide
SELTV

SEQ ID NO: 5509 - protein, 5 aa, Artificial Sequence
  Description of Artificial Sequence: Synthetic peptide
NELLV

SEQ ID NO: 5510 - protein, 5 aa, Artificial Sequence
  Description of Artificial Sequence: Synthetic peptide
TQLLV

SEQ ID NO: 5511 - protein, 5 aa, Artificial Sequence
  Description of Artificial Sequence: Synthetic peptide
QGLIV

SEQ ID NO: 5512 - protein, 5 aa, Artificial Sequence
  Description of Artificial Sequence: Synthetic peptide
QELVI

SEQ ID NO: 5513 - protein, 5 aa, Artificial Sequence
  Description of Artificial Sequence: Synthetic peptide
NELIV

SEQ ID NO: 5514 - protein, 5 aa, Artificial Sequence
  Description of Artificial Sequence: Synthetic peptide
TELLT

SEQ ID NO: 5515 - protein, 5 aa, Artificial Sequence
  Description of Artificial Sequence: Synthetic peptide
GELIT

SEQ ID NO: 5516 - protein, 5 aa, Artificial Sequence
  Description of Artificial Sequence: Synthetic peptide
SQLSM

SEQ ID NO: 5517 - protein, 5 aa, Artificial Sequence
  Description of Artificial Sequence: Synthetic peptide
RALLI

SEQ ID NO: 5518 - protein, 5 aa, Artificial Sequence
  Description of Artificial Sequence: Synthetic peptide
ENLLI

SEQ ID NO: 5519 - protein, 5 aa, Artificial Sequence
  Description of Artificial Sequence: Synthetic peptide
PDLKR

SEQ ID NO: 5520 - protein, 5 aa, Artificial Sequence
  Description of Artificial Sequence: Synthetic peptide
GQLVT

SEQ ID NO: 5521 - protein, 5 aa, Artificial Sequence
  Description of Artificial Sequence: Synthetic peptide
GQLLS

SEQ ID NO: 5522 - protein, 5 aa, Artificial Sequence
  Description of Artificial Sequence: Synthetic peptide
GELNP

SEQ ID NO: 5523 - protein, 5 aa, Artificial Sequence
  Description of Artificial Sequence: Synthetic peptide
GQLIQ

SEQ ID NO: 5524 - protein, 5 aa, Artificial Sequence
  Description of Artificial Sequence: Synthetic peptide
PTLVG

SEQ ID NO: 5525 - protein, 5 aa, Artificial Sequence
  Description of Artificial Sequence: Synthetic peptide
LVLAD

SEQ ID NO: 5526 - protein, 5 aa, Artificial Sequence
  Description of Artificial Sequence: Synthetic peptide
EALRA

SEQ ID NO: 5527 - protein, 5 aa, Artificial Sequence
  Description of Artificial Sequence: Synthetic peptide
GQLTL

SEQ ID NO: 5528 - protein, 5 aa, Artificial Sequence
  Description of Artificial Sequence: Synthetic peptide
NVLGT

SEQ ID NO: 5529 - protein, 5 aa, Artificial Sequence
  Description of Artificial Sequence: Synthetic peptide
KGLGP

SEQ ID NO: 5530 - protein, 5 aa, Artificial Sequence
  Description of Artificial Sequence: Synthetic peptide
MQLRR

SEQ ID NO: 5531 - protein, 5 aa, Artificial Sequence
  Description of Artificial Sequence: Synthetic peptide
VLLPN

SEQ ID NO: 5532 - protein, 5 aa, Artificial Sequence
  Description of Artificial Sequence: Synthetic peptide
MRLGD

SEQ ID NO: 5533 - protein, 5 aa, Artificial Sequence
  Description of Artificial Sequence: Synthetic peptide
GQLAQ

SEQ ID NO: 5534 - protein, 5 aa, Artificial Sequence
  Description of Artificial Sequence: Synthetic peptide
GELVT

SEQ ID NO: 5535 - protein, 5 aa, Artificial Sequence
  Description of Artificial Sequence: Synthetic peptide
VDLAV

SEQ ID NO: 5536 - protein, 5 aa, Artificial Sequence
  Description of Artificial Sequence: Synthetic peptide
AQLTI

SEQ ID NO: 5537 - protein, 5 aa, Artificial Sequence
  Description of Artificial Sequence: Synthetic peptide
DALPA

SEQ ID NO: 5538 - protein, 5 aa, Artificial Sequence
  Description of Artificial Sequence: Synthetic peptide
SVLQL

SEQ ID NO: 5539 - protein, 5 aa, Artificial Sequence
  Description of Artificial Sequence: Synthetic peptide
GPLGN

SEQ ID NO: 5540 - protein, 5 aa, Artificial Sequence
  Description of Artificial Sequence: Synthetic peptide
GHLLL

SEQ ID NO: 5541 - protein, 5 aa, Artificial Sequence
  Description of Artificial Sequence: Synthetic peptide
DVLDP

SEQ ID NO: 5542 - protein, 5 aa, Artificial Sequence
  Description of Artificial Sequence: Synthetic peptide
SSLSI

SEQ ID NO: 5543 - protein, 5 aa, Artificial Sequence
  Description of Artificial Sequence: Synthetic peptide
KMLAD

SEQ ID NO: 5544 - DNA, 40 bp, Artificial Sequence
  Description of Artificial Sequence: Synthetic oligonucleotide
tgcagtgccccgacaggaccagcagggggcgctagtgagg

SEQ ID NO: 5545 - DNA, 17 bp, Artificial Sequence
  Description of Artificial Sequence: Synthetic oligonucleotide
gccagcaggtggcgcct

SEQ ID NO: 5546 - DNA, 21 bp, Artificial Sequence
  Description of Artificial Sequence: Synthetic oligonucleotide
caggaccagcagggggcgcta

SEQ ID NO: 5547 - DNA, 31 bp, Artificial Sequence
  Description of Artificial Sequence: Synthetic oligonucleotide
gtcgcggcaagagtgccagcagggggcgcta

SEQ ID NO: 5548 - DNA, 37 bp, Artificial Sequence
  Description of Artificial Sequence: Synthetic oligonucleotide
cagtgcagtgccccgacaggaccagcagggggcgcta

SEQ ID NO: 5549 - DNA, 40 bp, Artificial Sequence
  Description of Artificial Sequence: Synthetic oligonucleotide
tgcagtgccccgacaggaccgctagatggcgctagtgagg

SEQ ID NO: 5550 - DNA, 40 bp, Artificial Sequence
  Description of Artificial Sequence: Synthetic oligonucleotide
tgcactgcgggcacacgaccgctagatggcgctagactgg

SEQ ID NO: 5551 - protein, 7 aa, Artificial Sequence
  Description of Artificial Sequence: Synthetic peptide
  MOD_RES (4)..(4): Any amino acid
RKSXLGV

SEQ ID NO: 5552 - protein, 5 aa, Artificial Sequence
  Description of Artificial Sequence: Synthetic peptide
SDLGV

SEQ ID NO: 5553 - protein, 5 aa, Artificial Sequence
  Description of Artificial Sequence: Synthetic peptide
YKLKR

SEQ ID NO: 5554 - protein, 5 aa, Artificial Sequence
  Description of Artificial Sequence: Synthetic peptide
GELVR

SEQ ID NO: 5555 - protein, 5 aa, Artificial Sequence
  Description of Artificial Sequence: Synthetic peptide
ATLAD

SEQ ID NO: 5556 - DNA, 12 bp, Artificial Sequence
  Description of Artificial Sequence: Synthetic oligonucleotide
caagcgtggtgc

SEQ ID NO: 5557 - DNA, 15 bp, Artificial Sequence
  Description of Artificial Sequence: Synthetic oligonucleotide
caagcgtggtgcgct

SEQ ID NO: 5558 - DNA, 15 bp, Unknown
  Description of Unknown: CTCF binding site sequence
ccagcagggggcgct

SEQ ID NO: 5559 - DNA, 12 bp, Artificial Sequence
  Description of Artificial Sequence: Synthetic oligonucleotide
cgagcgtggtgc

SEQ ID NO: 5560 - DNA, 15 bp, Artificial Sequence
  Description of Artificial Sequence: Synthetic oligonucleotide
cgagcgtggtgcgct

SEQ ID NO: 5561 - protein, 7 aa, Artificial Sequence
  Description of Artificial Sequence: Synthetic peptide
RPDTMKR

SEQ ID NO: 5562 - DNA, 12 bp, Artificial Sequence
  Description of Artificial Sequence: Synthetic oligonucleotide
caaggaggggac

SEQ ID NO: 5563 - DNA, 15 bp, Artificial Sequence
  Description of Artificial Sequence: Synthetic oligonucleotide
caaggaggggacgct

SEQ ID NO: 5564 - DNA, 12 bp, Artificial Sequence
  Description of Artificial Sequence: Synthetic oligonucleotide
cgaggaggggac

SEQ ID NO: 5565 - DNA, 15 bp, Artificial Sequence
  Description of Artificial Sequence: Synthetic oligonucleotide
cgaggaggggacgct

SEQ ID NO: 5566 - DNA, 12 bp, Artificial Sequence
  Description of Artificial Sequence: Synthetic oligonucleotide
ccagcgtggtgc

SEQ ID NO: 5567 - DNA, 15 bp, Artificial Sequence
  Description of Artificial Sequence: Synthetic oligonucleotide
ccagcgtggtgcgct

SEQ ID NO: 5568 - DNA, 18 bp, Artificial Sequence
  Description of Artificial Sequence: Synthetic oligonucleotide
tgcaaggaggtgacgcta

SEQ ID NO: 5569 - DNA, 18 bp, Artificial Sequence
  Description of Artificial Sequence: Synthetic oligonucleotide
tgcgaggaggtgacgcta

SEQ ID NO: 5570 - DNA, 18 bp, Artificial Sequence
  Description of Artificial Sequence: Synthetic oligonucleotide
tgccagcgtggtgcgcta

SEQ ID NO: 5571 - DNA, 18 bp, Artificial Sequence
  Description of Artificial Sequence: Synthetic oligonucleotide
tgcaagcgtggtgcgcta

SEQ ID NO: 5572 - DNA, 18 bp, Artificial Sequence
  Description of Artificial Sequence: Synthetic oligonucleotide
tgcgagcgtggtgcgcta

SEQ ID NO: 5573 - DNA, 18 bp, Artificial Sequence
  Description of Artificial Sequence: Synthetic oligonucleotide
tgccagcaggtggcgcta

SEQ ID NO: 5574 - DNA, 12 bp, Artificial Sequence
  Description of Artificial Sequence: Synthetic oligonucleotide
ccagcgtggtgc

SEQ ID NO: 5575 - DNA, 12 bp, Artificial Sequence
  Description of Artificial Sequence: Synthetic oligonucleotide
caagcgtggtgc

What is claimed is:

1. An engineered CCCTC-binding factor (CTCF) variant comprising at least one amino acid residue in at least one zinc finger that differs in sequence from the amino acid sequence of a wild-type CTCF, wherein the engineered CTCF variant binds to a mutant CTCF binding sequence (CBS) with a higher affinity than wild-type CTCF,
    wherein the mutant CBS has G, G, and A residues at positions 2, 5, and 11 of the consensus CBS motif, respectively, and the engineered CTCF comprises:
       (i) the amino acid sequence GNLVR (SEQ ID NO: 117), GNLRR (SEQ ID NO: 118), GNLAR (SEQ ID NO: 138), GNLMR (SEQ ID NO: 139), ANLRR (SEQ ID NO: 69), SNLRR (SEQ ID NO: 116), or NNLRR (SEQ ID NO: 121) at ZF4 positions +2 to +6 of the engineered CTCF;
       (ii) the amino acid sequence EHMNR (SEQ ID NO: 126), EHMKR (SEQ ID NO: 123), EHMRR (SEQ ID NO: 34), SHMNR (SEQ ID NO: 146), SHMRR (SEQ ID NO: 147), THMKR (SEQ ID NO: 33), or DHMNR (SEQ ID NO: 32) at ZF6 positions +2 to +6 of the engineered CTCF; and
       (iii) the amino acid sequence EHLKV (SEQ ID NO: 13), EHLAE (SEQ ID NO: 151), STLNE (SEQ ID NO: 152), DHLQV (SEQ ID NO: 12), EHLNV (SEQ ID NO: 9), DHLNT (SEQ ID NO: 155), EHLQA (SEQ ID NO: 156), or HHLMH (SEQ ID NO: 157) at ZF7 positions +2 to +6 of the engineered CTCF.

2. A pharmaceutical composition comprising an engineered CTCF variant according to claim 1.

3. A gene expression system for regulation of a gene, the system comprising a nucleic acid encoding an engineered CTCF variant according to claim 1.

4. A kit comprising an engineered CTCF variant according to claim 1.

5. A nucleic acid encoding an engineered CTCF variant according to claim 1.

6. A method of altering expression of a gene under the control of a mutant CBS, wherein the mutant CBS has G, G, and A residues at positions 2, 5, and 11 of the consensus CBS motif, respectively, the method comprising contacting the mutant CBS with an engineered CTCF according to claim 1, thereby regulating the expression of the gene.

* * * * *